United States Patent
Hymus et al.

(10) Patent No.: US 10,184,130 B2
(45) Date of Patent: Jan. 22, 2019

(54) RESOURCE USE EFFICIENCY IMPROVEMENT IN PLANTS

(71) Applicant: Koch Biological Solutions, LLC, Hayward, CA (US)

(72) Inventors: Graham J. Hymus, Castro Valley, CA (US); T. Lynne Reuber, San Mateo, CA (US); Colleen M. Marion, San Mateo, CA (US); Oliver J. Ratcliffe, Oakland, CA (US); Jeffrey M. Libby, Cupertino, CA (US)

(73) Assignee: KOCH BIOLOGICAL SOLUTIONS, LLC, Hayward, CA (US)

( * ) Notice: Subject to any disclaimer, the term of this patent is extended or adjusted under 35 U.S.C. 154(b) by 278 days.

(21) Appl. No.: 15/025,413

(22) PCT Filed: Oct. 31, 2014

(86) PCT No.: PCT/US2014/063345
§ 371 (c)(1),
(2) Date: Mar. 28, 2016

(87) PCT Pub. No.: WO2015/069557
PCT Pub. Date: May 14, 2015

(65) Prior Publication Data
US 2016/0272988 A1    Sep. 22, 2016

Related U.S. Application Data

(60) Provisional application No. 61/900,224, filed on Nov. 5, 2013.

(51) Int. Cl.
*A01H 5/00* (2018.01)
*C12N 15/82* (2006.01)
*C07K 14/415* (2006.01)

(52) U.S. Cl.
CPC ........ *C12N 15/8261* (2013.01); *C07K 14/415* (2013.01); *C12N 15/8223* (2013.01); *Y02A 40/146* (2018.01)

(58) Field of Classification Search
None
See application file for complete search history.

(56) References Cited

U.S. PATENT DOCUMENTS

| | | | |
|---|---|---|---|
| 2004/0187175 A1 | 9/2004 | Wu et al. | |
| 2007/0022495 A1* | 1/2007 | Reuber | C07K 14/415 800/279 |
| 2007/0061911 A9* | 3/2007 | Zhang | C07K 14/415 800/278 |
| 2012/0137382 A1* | 5/2012 | Repetti | C07K 14/415 800/263 |
| 2014/0041073 A1* | 2/2014 | Marion | C12N 15/8269 800/260 |
| 2015/0247159 A1* | 9/2015 | Hymus | C12N 15/8269 800/275 |

OTHER PUBLICATIONS

PCT International Search Report dated Apr. 23, 2015 issued for PCT/US14/63345.
Perry et al. Raising yield potential of wheat II. Increasing photosynthetic capacity and efficiency J Ex Bot. Jan. 2011. vol. 62 No. 2 pp. 453-466.

* cited by examiner

*Primary Examiner* — Vinod Kumar

(57) ABSTRACT

Polynucleotides and polypeptides incorporated into expression vectors are introduced into plants and were ectopically expressed. These polypeptides may confer at least one regulatory activity and increased yield, increased resource use efficiency, increased water use efficiency, increased light use efficiency, increased photosynthetic capacity, increased photosynthetic rate, increased photosynthetic resource use efficiency, greater vigor, and/or greater biomass as compared to a control plant.

Figure 1A:
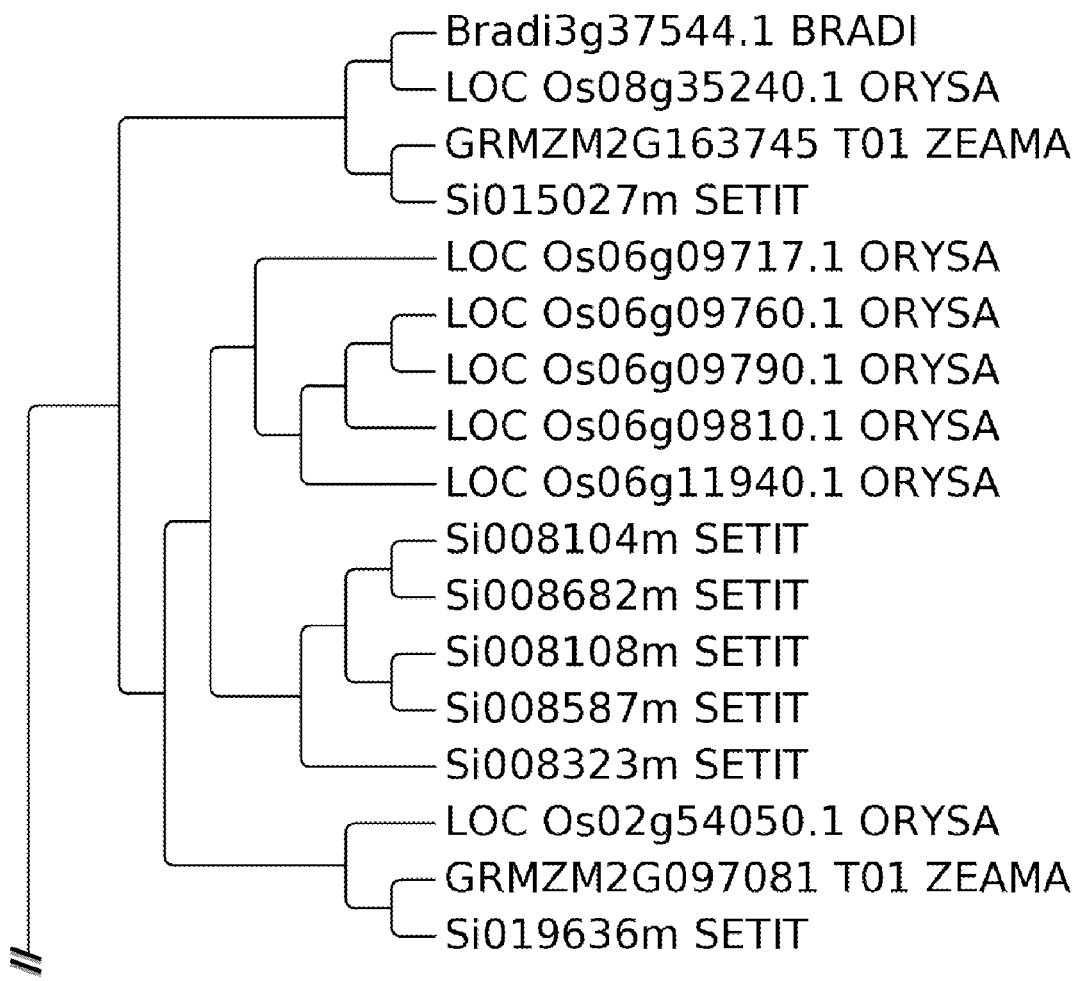

18 Claims, 115 Drawing Sheets
Specification includes a Sequence Listing.

```
AT4G31060.1           (2)  ----------------------------------------
POPTR_0006s08000.1    (4)  ----------------------------------------
LOC_Os08g35240.1     (54)  ----------------------------------------
Bradi3g37544.1       (58)  ----------------------------------------
GRMZM2G163745_T01    (60)  ----------------------------------------
Solyc06g054630.1.1   (48)  ----------------------------------------
AT5G21960.1          (40)  ----------------------------------------
LOC_Os02g54050.1     (42)  ----------------------------------------
GRMZM2G097081_T01    (32)  ----------------------------------------
LOC_Os06g09810.1     (50)  ----------------------------------------
LOC_Os06g09717.1     (34)  ----------------------------------------
LOC_Os06g11940.1     (56)  ----------------------------------------
LOC_Os06g09760.1     (36)  ----------------------------------------
LOC_Os06g09790.1     (52)  ----------------------------------------
GSVIVT01015037001    (22)  MSISEVFEIESHGSEDAPTRLLGVDPPHHINTSRHSQTQQ
Glyma09g08330.1      (24)  ----------------------------------------
Glyma15g19910.1      (44)  ----------------------------------------
AT1G74930.1          (10)  ----------------------------------------
AT1G19210.1          (12)  ----------------------------------------
GSVIVT01035502001     (6)  ----------------------------------------
POPTR_0006s23480.1   (14)  ----------------------------------------
POPTR_0018s08320.1   (26)  ----------------------------------------
Glyma17g33530.1      (46)  ----------------------------------------
Glyma04g06100.1      (16)  ----------------------------------------
Glyma06g06100.1      (18)  ----------------------------------------
POPTR_0006s14090.1   (38)  ----------------------------------------
POPTR_0006s14100.1   (28)  ----------------------------------------
Solyc12g009240.1.1    (8)  ----------------------------------------
Glyma13g17250.1      (30)  ----------------------------------------
Glyma17g05240.1      (20)  ----------------------------------------
```

FIG. 2A

```
AT4G31060.1         (2)  ------------------------MPPSPPKSPFISSSL
POPTR_0006s08000.1  (4)  ---------------------------MDPCKSSAPP
LOC_Os08g35240.1    (54) ------------------------MDHIGISGGGEGGVV
Bradi3g37544.1      (58) -------------------------------MDAA
GRMZM2G163745_T01   (60) -----------------------MDDGAGASRSDDG
Solyc06g054630.1.1  (48) ----------------------------------------
AT5G21960.1         (40) ----------------------------------------
LOC_Os02g54050.1    (42) ------------------------------MMSSSSP
GRMZM2G097081_T01   (32) -------------------------------MSSSPET
LOC_Os06g09810.1    (50) --------------------MEPVSFMQKSAAAAADGG
LOC_Os06g09717.1    (34) ----------------------------------------
LOC_Os06g11940.1    (56) -------------------MAYISTSSTDHSLSCMRMQT
LOC_Os06g09760.1    (36) ----------------------------MLLPRTDCQA
LOC_Os06g09790.1    (52) --------------------------------MQAN
GSVIVT01015037001   (22) NYTQILEQNPICSKEILGTCQNRNLRIRTRTEMVKKAIGV
Glyma09g08330.1     (24) ---------------------------MVKPKSVEKP
Glyma15g19910.1     (44) -------------------------------------MS
AT1G74930.1         (10) ----------------------------MVKQAMKEE
AT1G19210.1         (12) ----------------------------------------
GSVIVT01035502001   (6)  ---------------------------MVKPTAATATTTS
POPTR_0006s23480.1  (14) --------------------------MVRPGTSSSSVSS
POPTR_0018s08320.1  (26) -------------------------------MVKPSSSS
Glyma17g33530.1     (46) ----------------------------------------
Glyma04g06100.1     (16) ----------------------------------------
Glyma06g06100.1     (18) ---------------------------CGPPTRHELRTER
POPTR_0006s14090.1  (38) ---------------------------------MVKFNT
POPTR_0006s14100.1  (28) ---------------------------------MVKHSV
Solyc12g009240.1.1  (8)  ------------------------------MVKPNSKD
Glyma13g17250.1     (30) --------------------------------MMVKPSS
Glyma17g05240.1     (20) ---------------------------------MAKPSS
```

FIG. 2B

```
AT4G31060.1           (2)   KGAHEDRKFK CYRGVRKRSWGKWVSEIRVPKTGRRIWLGS
POPTR_0006s08000.1    (4)   KKVRQGRNSG TYRGVRMRTWGKWVSEIRVPKTGQRIWLGS
LOC_Os08g35240.1     (54)   SPAQPSSPER RYKGVRLRKWGRWVSEIRMPNSRERIWLGS
Bradi3g37544.1       (58)   GASRGEGSER RYKGVRLRKWGRWVSEIRMPNSRERIWLGS
GRMZM2G163745_T01    (60)   EVSPRLPAER RYKGVRLRKWGRWVSEIRMPNSRERVWLGS
Solyc06g054630.1.1   (48)   MENNSTHDQP KFKGVRLRKWGKWVSEVRLPNSRDRIWLGS
AT5G21960.1          (40)   -----MDASP KYTGVRKRKWGKWVAEIRLPNSRDRIWLGS
LOC_Os02g54050.1     (42)   VVASPPEMEK KYKGVRRRKWGKWVSEIRLPNSRDRIWLGS
GRMZM2G097081_T01    (32)   EAAGSSSSSR KFKGVRKRKWGKWVSEIRLPNSRERIWLGS
LOC_Os06g09810.1     (50)   SAAQAAAERR KYKGVRLRQWGKWAAEIRLPSSCERIWLGS
LOC_Os06g09717.1     (34)   MSSSSSATTT KYRGVRLRKWGKWVSEIRLPNSRERIWLGS
LOC_Os06g11940.1     (56)   KNTAAPAPEK KYKGVRLRQWGKWVAEIRLPNSRERVWLGS
LOC_Os06g09760.1     (36)   NGTSPAPVER KYRGVRLRQWGKWVAEIRLPNSLKRIWLGS
LOC_Os06g09790.1     (52)   TTQPAPEKET RYKGVRLRQWGKWVAEIRLPNSRKRIWLGS
GSVIVT01015037001    (22)   GSAPAESSDC RYKGVRKRKWGKWVSEIRLPNSRERIWLGS
Glyma09g08330.1      (24)   AEEQQQRSVS SYRGVRKRKWGKYVSEIRLPNSRQRIWLGS
Glyma15g19910.1      (44)   KEHIITAIVI VHVGVRKRKWGKYVSEIRLPNSRQRIWLGS
AT1G74930.1          (10)   EKKRNTAMQS KYKGVRKRKWGKWVSEIRLPHSRERIWLGS
AT1G19210.1          (12)   MEGSSSSMQS KYKGVRKRKWGKWVSEIRLPNSRERIWLGS
GSVIVT01035502001     (6)   EGGQPGNSET KYKGVRKRKWGKWVSEIRLPNSRERIWLGS
POPTR_0006s23480.1   (14)   EQQSDRTHEP KYKGVRKRKWGKWVSEIRLPNSRERIWLGS
POPTR_0018s08320.1   (26)   GQQSDRNHEP KYKGVRKRKWGKWVSEIRLPNSRERIWLGS
Glyma17g33530.1      (46)   ---------- MFKGVRKRKWGKWVSEIRLPNSRERIWLGS
Glyma04g06100.1      (16)   ---------- LYKGVRKRKWGKWVSEIRLPNSRERIWLGS
Glyma06g06100.1      (18)   RKSHVNLHVN LYKGVRKRKWGKWVSEIRLPNSRERIWLGS
POPTR_0006s14090.1   (38)   EKPVAERSDS KYKGVRKRKWGRWVSEIRLPNSRERIWLGS
POPTR_0006s14100.1   (28)   EKPVAERSDS KFKGVRKRKWGKWVSEIRLPNSRERIWLGS
Solyc12g009240.1.1    (8)   TEFSQSSSSS LYRGVRKRKWGKWVSEIRLPNSRERIWLGS
Glyma13g17250.1      (30)   EKPEEHRDSK YYKGVRKRKWGKWVSEIRLPNSRQRIWLGS
Glyma17g05240.1      (20)   EKPEEHSDSK YYKGVRKRKWGKWVSEIRLPNSRQRIWLGS
Consensus           (511)   XXXGVRXRXWGXXXXEXRXPXXXXRXWLGS
```

FIG. 2C

```
AT4G31060.1              (2)   YDAPEKAARAYDAALFCIRGE----KGVYNFPTDKKPQL-
POPTR_0006s08000.1       (4)   YDAPEKAARAYDAAQYCIRGE----RGQFNFPAERRPQL-
LOC_Os08g35240.1        (54)   YESAEKAARAFDAAVCLRGSRG--AGSLNFPESPPPDVR
Bradi3g37544.1          (58)   YESAEKAALAFDAAVCLRGSR---AGSLNFPEC-PPDV-
GRMZM2G163745_T01       (60)   YESAEKAARAFDAAVCLRGSR---AGSLNFPES-PPNV-
Solyc06g054630.1.1      (48)   YDSAEKAARAFDAAQFCLRGP----KAKFNFPDS-PPDI-
AT5G21960.1             (40)   FDSAEKAARAFDAALYCLRGP----GARFNFPDN-PPEI-
LOC_Os02g54050.1        (42)   YDSPEKAARAFDAAFVTLRGHGAA-GADLNFPDS-PPSC-
GRMZM2G097081_T01       (32)   YDAPDKAARAFDAAFVCLRGRGAA-GADLNFPDSPPPCR-
LOC_Os06g09810.1        (50)   YDTPEKAARAFDAAFICLRGVQA--IAGLNFPESPPPPT-
LOC_Os06g09717.1        (34)   YDTPEEAARAFDAAFVCLRGGGEAAGNGINFPGS-PPAV-
LOC_Os06g11940.1        (56)   YDTPEKAARAFDAAFVFLRGAGAADAAGLNFPDS-PLPV-
LOC_Os06g09760.1        (36)   YDSPEKAARAFDAAFICLRGGEA--IAGLNFPES-PPTV-
LOC_Os06g09790.1        (52)   YYTPEKAARAFDAAFICLRGGEA--IAGLNFTES-PPAV-
GSVIVT01015037001       (22)   YDTAEKAARAFDAALYCLRGR----TAKFNFPEN-PPKI-
Glyma09g08330.1         (24)   YDSAEKAARAFDAAMFCLRGS----GAKFNFPSD-PPNI-
Glyma15g19910.1         (44)   YDSAEKAARAFDAAMFCLRGS----GANFNFPSD-RPNI-
AT1G74930.1             (10)   YDTPEKAARAFDAAQFCLRGG----DANFNFPNN-PPSI-
AT1G19210.1             (12)   YDTPEKAARAFDAALYCLRGN----NAKFNFPDN-PPVI-
GSVIVT01035502001        (6)   YDTPEKAARAFDAALFCLRGH----GAKFNFPDN-PPDI-
POPTR_0006s23480.1      (14)   YDTPEKAARAFDAALYCLRGS----GAKFNFPDN-PPDI-
POPTR_0018s08320.1      (26)   YDTPLKAARAFDAALYCLRGS----GAKFNFPDN-PPDI-
Glyma17g33530.1         (46)   YDTQVKAARAFDAALYCLRGQ----SATFNFPDT-PRHLE
Glyma04g06100.1         (16)   YDSPEKAARAFDAALYCLRGR----HANFNFPNT-PCNMD
Glyma06g06100.1         (18)   YDSPEKAARAFDAALYCLRGR----HANFNFPNT-PCNMD
POPTR_0006s14090.1      (38)   YDSAEKAAHAFDAALFCLRGN----TMKFNFSEN-PPNI-
POPTR_0006s14100.1      (28)   YDSAEKAARAFDAALFCLRGR----VAKFNFPEN-PPNI-
Solyc12g009240.1.1       (8)   YDTPEKAAKAFDAALFCLRGK----GANFNFPEN-PPEI-
Glyma13g17250.1         (30)   FDTPEKAARAFDAAMFCLRGR----NAKFNFPDN-PPDI-
Glyma17g05240.1         (20)   YDTPEKAARAFDAAMFCLRGR----NAKFNFPDN-PPDI-
Consensus              (511)   XXXXXXAAXAXDAAXXXXRG
```

FIG. 2D

```
AT4G31060.1            (2)  ---PEG---SVRPLSKLDIQTIATNYASSVVHVPSHAT--
POPTR_0006s08000.1     (4)  ---PSG---PVDALSKKEIKAIAFNFASSNA---------
LOC_Os08g35240.1      (54)  RRFPGA------ALTVEQIQAEAARHANRPFPANTAAAGG
Bradi3g37544.1        (58)  QYIPGS------LPTPERIQAVAARHANSACPAPAARV--
GRMZM2G163745_T01     (60)  RYVPGA------LLTPEQIQAEAARHANQQLPSRPVAS--
Solyc06g054630.1.1    (48)  ---SGG-----QRLSPAEIQAVAARFANDYSPSVVQEI--
AT5G21960.1           (40)  ---PGG-----RSLTPQQIQVVASRFACEEELLPPEQH--
LOC_Os02g54050.1      (42)  ---DAR------SSDPRQVQAAALSHANRAHVTPQQAAAA
GRMZM2G097081_T01     (32)  ---AGG-----CSSDPREVQAAALSHANRAAVTAQQAAAA
LOC_Os06g09810.1      (50)  ---AAR------TGDLREVYAFAVSHANRPSAEAAPADIV
LOC_Os06g09717.1      (34)  ----------ARTSDPQEVYAAAVSHANNRPPPPPSAR--
LOC_Os06g11940.1      (56)  ---VAR------TRDLREVYAFAVSHANRPPPVAGETAAT
LOC_Os06g09760.1      (36)  ---VAR------TSDPREVLAYATSHANRLGCHHCTGR--
LOC_Os06g09790.1      (52)  ---VAR------TTDPREVLAFATSHANLLSLLDAAIA--
GSVIVT01015037001     (22)  ---AGG-----GSLTRSEIRAAAAKFANEDS---------
Glyma09g08330.1       (24)  ---AGG-----GNMTSSQIQIAAARFANSEPRNERSDQ--
Glyma15g19910.1       (44)  ---AGG-----RNMTPSQIQIAAARFANSEPRKECSGK--
AT1G74930.1           (10)  ---SVE-----KSLTPPEIQEAAARFANTFQDIVK-----
AT1G19210.1           (12)  ---SGG-----RNLSRSEIREAAARFANS-----------
GSVIVT01035502001      (6)  ---PGR-----ESLTPSEIQLVAARFANEEPPKECSELE-
POPTR_0006s23480.1    (14)  ---VGG-----RSLTPQEVQEVAARFANEEPTSSTAM---
POPTR_0018s08320.1    (26)  ---VGG-----QSLSSQEIQEVAARFANEEPTSSSTAT--
Glyma17g33530.1       (46)  TNMVLSRDKQPQPLSHQEIQEVAVKFANN-----------
Glyma04g06100.1       (16)  TTNAPH-----QSLTPQEIQEVAANFANQAPLLQKPQE--
Glyma06g06100.1       (18)  TATNAP---PNQSLTPQEIQEVAAKFANQQVDRGDMMD--
POPTR_0006s14090.1    (38)  ---AGG-----GSLSPSEIQEAAARFANSEPQRGQSGKL-
POPTR_0006s14100.1    (28)  ---AGG-----RSLSPAEIQEAAARFANSEPQRSQPDRF-
Solyc12g009240.1.1     (8)  ---RNG-----RTMTPSEIQSAAAQFANNTEPELIRVG--
Glyma13g17250.1       (30)  ---AGG-----ESMTPSQIQVAAAQFANAGPHEGHSGR--
Glyma17g05240.1       (20)  ---AGG-----TSMTPSQIQIAAAQFANAGPHEGHSGR--
```

FIG. 2E

```
AT4G31060.1           (2)  ------TLPATTQVPSEVPASS-----DVSASTEITEM--
POPTR_0006s08000.1    (4)  ------SSVSPSVITPVEMVEP------------------
LOC_Os08g35240.1     (54)  ------SSSSYSISQRQEAAAP-----ARSTSNDDTAMSS
Bradi3g37544.1       (58)  ------VAASSNAGAASQEAPA-----TARTSTSVDATGC
GRMZM2G163745_T01    (60)  ------ALQPAAAPPAGGPSSDRTTLSMPSTDYSSGAAVC
Solyc06g054630.1.1   (48)  ------RRDDHHHDHEGNIGNI-----NSHVINMEKDEIS
AT5G21960.1          (40)  ------HPSPPRGDHNTEEEVIISARGEINSGSGGPTLGQ
LOC_Os02g54050.1     (42)  LMSPPSLSPPPGFATGSEVVAP-----AVRADGSID----
GRMZM2G097081_T01    (32)  LTMDGGGADGSAPPWDYYYYYS-----VAHDAGGVLGGAA
LOC_Os06g09810.1     (50)  V-----PAQVATEESDGVVRGN-----AAPPPVQVAAGS-
LOC_Os06g09717.1     (34)  ------ATSSALPWEEAPVVAA-----QEAAADMAPDVVV
LOC_Os06g11940.1     (56)  ALAAMAALEHNEVRENIAPSSP-----LSAVQVAAPPAGS
LOC_Os06g09760.1     (36)  ----------------------------------------
LOC_Os06g09790.1     (52)  ------QEEEAHSFKKEEEAQV-----EEKTAEESSDVVR
GSVIVT01015037001    (22)  ------STASTSHSIRIHYFQP------------------
Glyma09g08330.1      (24)  ------PVESLTSDEETASFPV-----ISDTDTSSPPLSD
Glyma15g19910.1      (44)  ------PVESLTSIEETTSFPV-----NSDTDTSSPLSVV
AT1G74930.1          (10)  ------GEEESGLVPGSEIRPE-----SPSTSASVATSTV
AT1G19210.1          (12)  ------AEDDSSGGAGYEIRQE-----SASTSMDVDS---
GSVIVT01035502001     (6)  ------SQHSQSESHHYNYTPS-----CSLSEQLENETI-
POPTR_0006s23480.1   (14)  ------GGESSSHVENYTSSSS-----DCGAGQMDSDT--
POPTR_0018s08320.1   (26)  ------RGESSEHVENDTSSSS-----DGGAGDTID----
Glyma17g33530.1      (46)  ------DDHPLEEEEWDWDT--------------------
Glyma04g06100.1      (16)  ------PLEYKCEMKWGWCTNT-----TCTPTTTASSCST
Glyma06g06100.1      (18)  ------WTFLNVFDFSNEVVLP-----AVGSDYNDLYNSE
POPTR_0006s14090.1   (38)  ------EADQSTSVSESRPESP-----CLSAASDGTVRDM
POPTR_0006s14100.1   (28)  ------ETDQSVSVSESRAESP-----CPSVVSDGTVQME
Solyc12g009240.1.1    (8)  ------PRENSDLSSSSSEIFR-----AESPSVSVSDRVE
Glyma13g17250.1      (30)  ------PEHSPMQSLSPSVSEG-----TVLTDSDVTT---
Glyma17g05240.1      (20)  ------PEHPPMESPSPSVSEG-----TIQTDSDVPT---
```

FIG. 2F

| | | |
|---|---|---|
| AT4G31060.1 | (2) | ----------------------VDEY-------------- |
| POPTR_0006s08000.1 | (4) | ---------------------------------------- |
| LOC_Os08g35240.1 | (54) | VPSTDGGAADYDGGDDV-----ID-W-------------- |
| Bradi3g37544.1 | (58) | DDM------------------LDYW-------------- |
| GRMZM2G163745_T01 | (60) | GDDEA----------------LD-W--------------- |
| Solyc06g054630.1.1 | (48) | LSTTSCDRVVQMGTSNTVAE--MD-WAFHNDMMENYSYNA |
| AT5G21960.1 | (40) | VGEDNNNEGNSNDT--------SSYW-------------- |
| LOC_Os02g54050.1 | (42) | ------------------------W--------------- |
| GRMZM2G097081_T01 | (32) | ATSSTAEVVAPVRADGS-----ID-W-------------- |
| LOC_Os06g09810.1 | (50) | ---------------------LD-W-------------- |
| LOC_Os06g09717.1 | (34) | LPSSPVNVLAAAGS--------FEYW-------------- |
| LOC_Os06g11940.1 | (56) | ---------------------FD-W-------------- |
| LOC_Os06g09760.1 | (36) | ---------------------------------------- |
| LOC_Os06g09790.1 | (52) | ANAAPPPPVQVAGGS-------FD-W-------------- |
| GSVIVT01015037001 | (22) | -------------------------F-------------- |
| Glyma09g08330.1 | (24) | VTFQNDAE--------------LVTG-------------- |
| Glyma15g19910.1 | (44) | TIQNDTE---------------VATG-------------- |
| AT1G74930.1 | (10) | D---------------------YD-F-------------- |
| AT1G19210.1 | (12) | ---------------------------------------- |
| GSVIVT01035502001 | (6) | ---------------------MD-G--------------- |
| POPTR_0006s23480.1 | (14) | ---------------------ID-W-------------- |
| POPTR_0018s08320.1 | (26) | ------------------------W--------------- |
| Glyma17g33530.1 | (46) | ---------------------MD-W-------------- |
| Glyma04g06100.1 | (16) | TMYECDGTVQVDHGD-------MD-W-------------- |
| Glyma06g06100.1 | (18) | LHKMHSDSVYNNNKDKTRHRLCQTIY-------------- |
| POPTR_0006s14090.1 | (38) | ---------------------------------------- |
| POPTR_0006s14100.1 | (28) | GGELM-------------------W--------------- |
| Solyc12g009240.1.1 | (8) | SEKTEITLGNDF----------IDVYRVESRVESEKTEMS |
| Glyma13g17250.1 | (30) | ---------------------LN-G-------------- |
| Glyma17g05240.1 | (20) | ---------------------LN-G-------------- |

FIG. 2G

```
AT4G31060.1          (2)  ----------------YLPTDATAESIF--SVEDLQLDSF
POPTR_0006s08000.1   (4)  ---SLPNLQVSS----ATGNAGNVEGYVPAS---------
LOC_Os08g35240.1     (54) ---SFMDTLPAM----SSSAASTNADLVP-AMDDFMYGFL
Bradi3g37544.1       (58) ---SFMDELPSSMPASSSTSAANADIVIP-AMDDFMYGFS
GRMZM2G163745_T01    (60) ---SFMDALPPMPPASSSVGMGNSAHTVPAAMDDFMYGSP
Solyc06g054630.1.1   (48) SGPPPEYFCDPY----YIVGGGGAG----VLDNLSSNLY
AT5G21960.1          (40) --PLIWEEENFV----GPPNSDHEFGFFT---DDSTNLYF
LOC_Os02g54050.1     (42) --RPVMAHPPPL----YSPPG---------WGGGHAYDFL
GRMZM2G097081_T01    (32) --RPVMAHPPPL----FSPT----------GWGSNAYDFL
LOC_Os06g09810.1     (50) --SQFMANPPPM----YSPTAT--------AGSQAMWP--
LOC_Os06g09717.1     (34) -------SQQPL----YSPTAA--------SLDLQRWMT-
LOC_Os06g11940.1     (56) --SQLMANSPPL----YSPIVIGSH-----AYDDLAVWP-
LOC_Os06g09760.1     (36) ----------------SSSGGGGDG---------------
LOC_Os06g09790.1     (52) ---SQLPLYSPT----TTPAAEH-------WEEDNVEG--
GSVIVT01015037001    (22) ---VFPEIF-------LIPGKGSDSMASFSTASTCLGIFF
Glyma09g08330.1      (24) ---SFPDMFSDF----GSGDFVPDFSDFP-SFDDFSRDFF
Glyma15g19910.1      (44) ---SFPGIFSGF----GSGNFVPEFSDFP-SFDDFGHDFF
AT1G74930.1          (10) ---SFLDLLPMNF---GFDSFSDDFSGFS-GGDRFT----
AT1G19210.1          (12) ---EFLSMLPTV----GSGNFASEFGLFP-GFDDFSDEYS
GSVIVT01035502001    (6)  ---SFWSIRDYS----YIDGGGL-------GIS-------
POPTR_0006s23480.1   (14) ---SFLNLL-------DSNEGASDFGLYH-GLDHMGGDYY
POPTR_0018s08320.1   (26) ---SFLNLL-------DSSEGASDFGLYH-GLDHMGGDYY
Glyma17g33530.1      (46) ---TFLNMLDDL--------NGSDFGLYV-GLDKM-----
Glyma04g06100.1      (16) ---TFLNVFD------YSNE----------GYEQLIEAD-
Glyma06g06100.1      (18) ---IFLTIIK------YMPSYMASYIYIL-ICDMYPFSF-
POPTR_0006s14090.1   (38) ---PFFDMAMST----SSSNHPTEYGIFP-GFDDLHSGFF
POPTR_0006s14100.1   (28) -DGPFLDMLMNT----GSCNHSTEYGIFQ-GFDDLYSDFF
Solyc12g009240.1.1   (8)  LDNGFVDMFSSL----GTVNDMSDFGIFP-GFDDLSGEFF
Glyma13g17250.1      (30) ---SLTDLFTPV----GSSGYASDYGIFP-GVDDFSGGFY
Glyma17g05240.1      (20) ---SVTDLFTPV----GSSGYASDYGIFP-GFDDFSGDFY
```

FIG. 2H

```
AT4G31060.1           (2)  -------------------------------LMMDIDWI
POPTR_0006s08000.1    (4)  -----------ASVPDLCSIDN----LQLDDLLMLDIEWI
LOC_Os08g35240.1     (54)  HTM--------PPSPCEDGGEDVMIDGNCNMDQTFFSVDL
Bradi3g37544.1       (58)  P----------PPRPAGEAAED--VIDDHGDDGHTFLSAL
GRMZM2G163745_T01    (60)  HL---------VVQPSEDATQD---VIDSDDDHTFISDDL
Solyc06g054630.1.1   (48)  SPPHF------PQRTTPSYDDD--DTGNGDDEHYSQQSFL
AT5G21960.1          (40)  PT---------QQQQQHQLSSDFYYDGACEDDFSHYNINL
LOC_Os02g54050.1     (42)  QPP--------PPSPPLPSCDD-----DMVDVVDESSASL
GRMZM2G097081_T01    (32)  QV---------PPPPAAVADED-----MLDDGVHGATASL
LOC_Os06g09810.1     (50)  -----------VTAPAAEADGE---------DDELATTCR
LOC_Os06g09717.1     (34)  -----------AAAAAEESIME-------DDDDEGTSDGL
LOC_Os06g11940.1     (56)  -----------TTQPVEEFSEE------DNENEGATSDEL
LOC_Os06g09760.1     (36)  ----------------------------------------
LOC_Os06g09790.1     (52)  -----------DIPVCSEISVE----TSSNSRYIGVVFQM
GSVIVT01015037001    (22)  -----------PVSPSIQLLSE----NMRAADFVIFSSLM
Glyma09g08330.1      (24)  L----------HELPGFNFGEE------NLDGLIIQDSFL
Glyma15g19910.1      (44)  V----------HELPGFDYGEE------NLDGLIIQDSFL
AT1G74930.1          (10)  -----------EILPIEDYGGE---------SLLDESLIL
AT1G19210.1          (12)  GDRFRE-----QLSPTQDYYQL------GEETYADGSMFL
GSVIVT01035502001     (6)  -----------PPSPMDESGGE---------EFFQQSSFL
POPTR_0006s23480.1   (14)  PPP--------TPPPPPDYNGD----DNNGDETFSHQSFL
POPTR_0018s08320.1   (26)  PPP--------PPPSEYSIGGD----DHNGDEAYSQQSFL
Glyma17g33530.1      (46)  -----------HPNDEIEGDDD------HDAFSNHSLLWS
Glyma04g06100.1      (16)  -------------------------HDDDDPFSH-QSFL
Glyma06g06100.1      (18)  -----------PYFSVKLNLSG----FAVLNFLVHKCAIA
POPTR_0006s14090.1   (38)  AP---------SFLPNLDHGEG-----FNLDGVLEEDSFL
POPTR_0006s14100.1   (28)  PP---------SLIPNLDYGEE-----TNLDGVLEQGSFL
Solyc12g009240.1.1    (8)  IPPPSSPQPSPLQMPNLESLEE-ENYLNYDGFQSQGTSFL
Glyma13g17250.1      (30)  V----------PEMLNFNYGEE------NGEGFIVDESFL
Glyma17g05240.1      (20)  V----------PEMPNVNYGEE------NGEGFIVDESFL
```

FIG. 21

```
AT4G31060.1              (2)  NNLI---------
POPTR_0006s08000.1       (4)  DSL----------
LOC_Os08g35240.1        (54)  WRF----------
Bradi3g37544.1          (58)  WKF----------
GRMZM2G163745_T01       (60)  WRF----------
Solyc06g054630.1.1      (48)  WNF----------
AT5G21960.1             (40)  WNF----------
LOC_Os02g54050.1        (42)  WSFDTRDSYFRY
GRMZM2G097081_T01       (32)  WSFDSRDSYFRY
LOC_Os06g09810.1        (50)  WSFDA--------
LOC_Os06g09717.1        (34)  WSFHYSPTRSKW
LOC_Os06g11940.1        (56)  WSFDV--------
LOC_Os06g09760.1        (36)  ------------
LOC_Os06g09790.1        (52)  HSYG---------
GSVIVT01015037001       (22)  QTY----------
Glyma09g08330.1         (24)  WNF----------
Glyma15g19910.1         (44)  WNF----------
AT1G74930.1             (10)  WDF----------
AT1G19210.1             (12)  WNF----------
GSVIVT01035502001        (6)  WNF----------
POPTR_0006s23480.1      (14)  WNF----------
POPTR_0018s08320.1      (26)  WNF----------
Glyma17g33530.1         (46)  WNF----------
Glyma04g06100.1         (16)  WNWNF--------
Glyma06g06100.1         (18)  LK-----------
POPTR_0006s14090.1      (38)  WNF----------
POPTR_0006s14100.1      (28)  WNF----------
Solyc12g009240.1.1       (8)  WNF----------
Glyma13g17250.1         (30)  WNF----------
Glyma17g05240.1         (20)  WNF----------
```

FIG. 2J

| | | |
|---|---|---|
| AT5G62610.1 | (104) | ---MDPP-LVNDSS--FSAANPSSYTLSEIWPF--PVNDA |
| LOC_Os07g09590.1 | (72) | ---MDPA----------------PSLAAELWRP------- |
| LOC_Os03g58830.1 | (84) | ---MDPA----------------PTLAAELWRT------- |
| GRMZM2G137358_T01 | (94) | ---MEPS----------------PAVAAELWCS------- |
| Si037131m | (86) | ---MDPA----------------PAVAAELWRP------- |
| Si030790m | (74) | ---MDPA--------------ASSVVAAELWRP------- |
| GRMZM2G008898_T01 | (100) | ---MDPA---------------SSVAAEFWRP------- |
| Solyc04g005130.2.1 | (76) | ---MDPHSTIMSAF--------QTATNLAEIWPY------- |
| Solyc05g006650.2.1 | (90) | ---MDPQASMMNHA----GGFQSPPFNLSEIWQF--PINAG |
| Glyma01g04610.1 | (70) | ---MDPAAMMNGGA------NPTSYHLSEIWQF-PPPNAP |
| AT1G59640.1 | (62) | ---MDPSGMMNEGG---------PFNLAEIWQFPLNGVST |
| Eucgr.B03392.1 | (92) | ---MDPPAAMINGGGSFPGGDPVPYNLADMWLP----PAG |
| POPTR_0008s19510.1 | (80) | MIRMDPPAMMNEGG---------PYTLEEIWQF------- |
| POPTR_0010s04920.1 | (68) | ---MDPPARMNEGG---------PYSLEEIWQF------- |
| Glyma04g34660.1 | (64) | ---MDPP-LISDST------FSPAYSLAEIWPG------- |
| Glyma06g20000.1 | (66) | ---MDPP-LITDST------FSPAYSLAEIWPG------- |
| Glyma05g01590.1 | (88) | ---MEPL-LFNDST-----FSSANPSLSEIWPS------- |
| Glyma17g10290.1 | (78) | ---MEPP-LINDST-----FSSANPSLSEIWPS------- |
| POPTR_0012s07470.1 | (102) | ---MDPP-LINEKS--FSAANPSSYSLTEIWPF--PPPSS |
| POPTR_0015s07930.1 | (98) | ---MDPP-LINETS--FSAANPSSYTLTEIWPFPPPPPSS |
| Eucgr.K02908.1 | (82) | ---MDPP-IVNESS--FSAANPSSYSLDEIWPF-NGEPGN |
| Eucgr.B00385.1 | (96) | ---MDAP-LVNASS--FSAANPSAYSLAEIWPL------- |

FIG. 5A

```
AT5G62610.1          (104)  VRSGLRLAVNSGRVFTRSEHSGNKDVSAA-EESTVTD---
LOC_Os07g09590.1      (72)  -----------------HHHRHHFEASSVVTDQGSGS---
LOC_Os03g58830.1      (84)  -------PYLGGGGGGGGGRGLEAAASGVTEQSNGS-RG
GRMZM2G137358_T01     (94)  -------PHLA------AGGGRPLEATSAVTEKSSGG---
Si037131m             (86)  -------PHLA------AGGGRAVEATSAVTEKSGGG---
Si030790m             (74)  -------PHHHHLAPAASGPHHEASSVVTTADRSNGG---
GRMZM2G008898_T01    (100)  -----------------PYHHLRASSVVTAAARSGG---
Solyc04g005130.2.1    (76)  -------HHL-------------------LDHTTNH---
Solyc05g006650.2.1    (90)  EGETPYSFPLSTAAAPQNVSDDVRNNDPMVLDRRTNNYSG
Glyma01g04610.1       (70)  DELGLRRPHFTHGFADFAPDPTRDAV----PGRDPAS---
AT1G59640.1           (62)  AGDSSRRSFVGPNQFGDADLTTAANGDPARMSHALSQAVI
Eucgr.B03392.1        (92)  GGLGLGRHPGARGIAQFLNGSGPNLEASG-GDPAVSAAEA
POPTR_0008s19510.1    (80)  ----------------PINGSGRGQFELLNLERRAAA---
POPTR_0010s04920.1    (68)  ----------------PINGSGRGHFDLLNLEQRAAA---
Glyma04g34660.1       (64)  ------MPHFP-------DHSHLTATAPTKGKDSTAA---
Glyma06g20000.1       (66)  ------MPHFPPPFPHPSSADHSTLTDLT-ATPRKRK---
Glyma05g01590.1       (88)  --------HFP-------------------SDHTPRK---
Glyma17g10290.1       (78)  --------HFP-------------------TDHTPSN---
POPTR_0012s07470.1   (102)  TALGLRMANLA-------DRDGSVDESTV-TEQRGGN---
POPTR_0015s07930.1    (98)  TRLGLRMDNLA-------DPDGSLEESTL-TDQSSGN---
Eucgr.K02908.1        (82)  GGLGLRMGNLSGFLDGQMNRDGSAEVSTV-TEQSGGG---
Eucgr.B00385.1        (96)  ----GGDTGIVGPGLRAGNLDGSVEESTV-TEQSGSG---
```

FIG. 5B

```
AT5G62610.1        (104)  LTAGWGSRKT--RDLNSE-DDS-SKMVSSS-------SSG
LOC_Os07g09590.1    (72)  -RGGGGSGRRRPRSDAGPEDDDLSKVVSTSAASGGGGGGG
LOC_Os03g58830.1    (84)  GGGGGGAGRRRQREAPALEDDS-SRIVSTS----GGGGGG
GRMZM2G137358_T01   (94)  -RGGGAVRRRPRETPVSEDDS-SRIVSTS-----GGGGG
Si037131m           (86)  -RGGGSAGRRKQREAPASEDDS-SRIVSTS-----GGGGG
Si030790m           (74)  RSGGGSSRRRPRRDAPAAEEEP-SKLASTSGTAAASGGGG
GRMZM2G008898_T01  (100)  ---GSSSRRRPRRDAAASSEEEPSKLVSTSGTAASSSAGC
Solyc04g005130.2.1  (76)  ----AATKRR--------DDDESAIAVSTS---------G
Solyc05g006650.2.1  (90)  GGGGGAARKR-------NEDDESAKGVSTS---------G
Glyma01g04610.1     (70)  ----IAQKKR--RDASAEEEES-AKGASTTNAVNEGGGVG
AT1G59640.1         (62)  EGISGAWKRR-------EDESKSAKIVSTI----------
Eucgr.B03392.1      (92)  RCGGGSRKRRDAEDESAAGSLSTSNGVPNG----------
POPTR_0008s19510.1  (80)  -----SARKR--REVDLDVDDS-SSSKPTTLSPTNANTNT
POPTR_0010s04920.1  (68)  -----SVRKR--RDVDLDVDDD-SSSKPTT----------
Glyma04g34660.1     (64)  ----------------------DEVLSST---------TT
Glyma06g20000.1     (66)  -----DCSSSSSSASAADEDDC-SKVLSST------TTAT
Glyma05g01590.1     (88)  ---------------------RRLSPSS-----------
Glyma17g10290.1     (78)  ---------------------KRHLSPS-----------
POPTR_0012s07470.1 (102)  -----RNGNRKARDLSSEEDDS-SIMVSTT-------TSA
POPTR_0015s07930.1  (98)  -----GTRIRKTRDFSSEKDDS-SKMVSTT-------TSA
Eucgr.K02908.1      (82)  -----GIGRK--RKDVSSEDES-SKMVSTS--------SA
Eucgr.B00385.1      (96)  -----RRRRR--MKDASSEDES-SKMVSSS------CVVG
```

FIG. 5C

```
AT5G62610.1         (104) NELK---ESGDKKRKLCGSESGN---------GDGSMR-P
LOC_Os07g09590.1     (72) QDSD---APEAKRLKPMKSSD-----------KNDSLR-T
LOC_Os03g58830.1     (84) QDLT---DSEAKRFKASKSSG-----------DNSSLR-T
GRMZM2G137358_T01    (94) QDLT---DLEAKRSKTNKSSN-----------NKGSLR-T
Si037131m            (86) QDLT---DSGAKRFKTNKSND-----------NNGNQR-T
Si030790m            (74) GGRDSADPEMAKRLKKMTSSD-------------DKIR-T
GRMZM2G008898_T01   (100) QDSA---DPEAKRLKQIAPS------------EKNDRR-T
Solyc04g005130.2.1   (76) NALT---ESDSKRLKATRSN-------------------E
Solyc05g006650.2.1   (90) NGLT---ESASKRMKVTRSN-----------ENCEAR-G
Glyma01g04610.1      (70) D---------GKRVKTSESGK-----------------G
AT1G59640.1          (62) ----GASEGENKRQKIDEVCD-----------------G
Eucgr.B03392.1       (92) -------ADGEKRLKTSGCKD-----------RSGDSK-A
POPTR_0008s19510.1   (80) NGLL--NDCDGKRLKAWGSRDDNHHHQQQQQQQQHDSR-S
POPTR_0010s04920.1   (68) --------NGLLRLKTSGSKDEDHH-------RHHDSK-D
Glyma04g34660.1      (64) ANLSNNDSGSNKRMKVGGSSF-----------ENDGFK-A
Glyma06g20000.1      (66) ANLSNNDSGSNKQMKLGGSSV-----------ENDGFK-A
Glyma05g01590.1      (88) ------DSASNKHIKLSAPESQD---------QNGALKVG
Glyma17g10290.1      (78) -----TDCGSNKHIKSSGSGSQD---------QNGALKAG
POPTR_0012s07470.1  (102) HDLN---DLNGKRRKISGSRN-----------ENNDSR-A
POPTR_0015s07930.1   (98) NDLN---DSNGKRRKISGSRS-----------ENNDSR-A
Eucgr.K02908.1       (82) DDLN---MSNGKRIKSLVSRH-----------DNGGSR-A
Eucgr.B00385.1       (96) SDLN--NSNGAKRAKIAGSRD-----------ENGSSK-A
```

FIG. 5D

```
AT5G62610.1         (104) EGETSSGGGGSKATEQKNKP----EPPK-DYIHVRARRGQ
LOC_Os07g09590.1     (72) EAGTDSGNSSK-AADKNATPP---EPPKQDYIHVRARRGQ
LOC_Os03g58830.1     (84) EAETDSRNASK-SGDQNPPPP---EPPKQDYIHVRARRGQ
GRMZM2G137358_T01    (94) EVETDSRSAGK-AVSKNIPAA---EPPKQDYIHVRARRGQ
Si037131m            (86) EAETQTRSAGK-GVSKNPPAP---EPPKQDYIHVRARRGQ
Si030790m            (74) EVETNSGNASK-SVDKKPAPP---EPPKQDYIHVRARRGQ
GRMZM2G008898_T01   (100) EAETNSGNASK-SADKKPAPK---EPPK-DYIHVRARRGQ
Solyc04g005130.2.1   (76) NGEYSGGNSGK-SSDQPAKPPA--EPPK-DYIHVRARRGQ
Solyc05g006650.2.1   (90) DGEGNSVK----SAEQPAKPA---EPPK-DYIHVRARRGQ
Glyma01g04610.1      (70) EGETSSGK----LAEQSGKPPS--EPPKQDYIHVRARRGQ
AT1G59640.1          (62) KAEAESLGT---ETEQKKQQM---EPTK-DYIHVRARRGQ
Eucgr.B03392.1       (92) EGQPSSAK----PTDESKPQP---EPSKQDYIHVRARRGQ
POPTR_0008s19510.1   (80) EAEPSSGK----LVEHKPQPP---EPPKQDYIHVRARRGQ
POPTR_0010s04920.1   (68) EAEPSSGK----HVEHKTQPP---EPSKQDYIHVRARRGQ
Glyma04g34660.1      (64) EAEASSVGGNK-SSEQSNKPC---EAPKPDYIHVRARRGQ
Glyma06g20000.1      (66) EAEASSAGGNK-SSEQSNKPC---EAPKQDYIHVRARRGQ
Glyma05g01590.1      (88) EVDATSVAGNK-LPQQTPKPSSSEQAPKQDYIHVRARRGQ
Glyma17g10290.1      (78) EVDATSVAGNK-LPEQTAKPSSSEQPPKQDYIHVRARRGQ
POPTR_0012s07470.1  (102) EIEASSAANNK-PAEPSSKPS---EPPMQDYIHVRSRRGQ
POPTR_0015s07930.1   (98) ETEASSAANNK-TAEQSSKPS---EPPKQDYIHVRARRGQ
Eucgr.K02908.1       (82) EGESSSAAGDK-QAGQIAKPS---EPPKKDYIHVRARRGQ
Eucgr.B00385.1       (96) EVEANSVACNKSSAEQSAKPS---EPPKQDYIHVRARRGQ
Consensus           (512)                                        RGQ
```

FIG. 5E

| | | |
|---|---|---|
| AT5G62610.1 | (104) | ATDRHSLAERARREKISEKMTALQDIIPGCNKIIGKALVL |
| LOC_Os07g09590.1 | (72) | ATDSHSLAERARREKISERMKILQDLVPGCNKVIGKASVL |
| LOC_Os03g58830.1 | (84) | ATDSHSLAERARREKISERMKILQDLVPGCNKVIGKASVL |
| GRMZM2G137358_T01 | (94) | ATDSHSLAERARREKISERMKVLQDLVPGCNKVIGKASVL |
| Si037131m | (86) | ATDSHSLAERARREKISERMKVLQDLVPGCNKVIGKASVL |
| Si030790m | (74) | ATDSHSLAERARREKISERMKVLQDLVPGCNKVIGKASVL |
| GRMZM2G008898_T01 | (100) | ATDSHSLAERARREKISERMKVLQDIVPGCNKVIGKASVL |
| Solyc04g005130.2.1 | (76) | ATDSHSLAERARREKISDRMKILQDLVPGCNKVIGKALVL |
| Solyc05g006650.2.1 | (90) | ATDSHSLAERARREKISERMKVLQDIVPGCNKVIGKALVL |
| Glyma01g04610.1 | (70) | ATDSHSLAERARREKISERMKILQDIVPGCNKVIGKALVL |
| AT1G59640.1 | (62) | ATDSHSLAERARREKISERMKILQDLVPGCNKVIGKALVL |
| Eucgr.B03392.1 | (92) | ATDSHSLAERARREKISERMKILQDIVPGCNKVIGRALVL |
| POPTR_0008s19510.1 | (80) | ATDSHSLAERARREKISERMKILQDIVPGCNKVTGKALVL |
| POPTR_0010s04920.1 | (68) | ATDSHSLAERARREKISERMKILQDLVPGCNKVIGKALVL |
| Glyma04g34660.1 | (64) | ATDSHSLAERARREKISERMKILQDLVPGCNKVIGKALVL |
| Glyma06g20000.1 | (66) | ATDSHSLAERARREKISERMKILQDLVPGCNKVIGKALVL |
| Glyma05g01590.1 | (88) | ATDNHSLAERARREKISERMKILQDLVPGCNKVIGKAFVL |
| Glyma17g10290.1 | (78) | ATDSHSLAERARREKISERMKILQDIVPGCNKVIGKALVL |
| POPTR_0012s07470.1 | (102) | ATDSHSLAERARRERIGERMKILQDLVPGCNKVIGKALAL |
| POPTR_0015s07930.1 | (98) | ATDSHSLAERARREKISERMNMLQDLVPGCNKVIGKALVL |
| Eucgr.K02908.1 | (82) | ATDSHSLAERARREKISERMKILQDLVPGCNKVIGKALIL |
| Eucgr.B00385.1 | (96) | ATDSHSLAERARREKISERMKTLQDLVPGCNKIIGKALVL |
| Consensus | (512) | ATDXHSLAERARREXIXXXMXXLQDXXPGCNKXXGXAXXL |

FIG. 5F

```
AT5G62610.1          (104)  DEIINYIQSLQRQVEFLSMKLEVVNSGASTGPTIGVFPSG
LOC_Os07g09590.1      (72)  DEIINYIQSLHQVEFLSMKLEAVNSHMI--NGIVAFPSK
LOC_Os03g58830.1      (84)  DEIINYIQALQRQVEFLSMKLEAVNAHVN--NGIEAFPPK
GRMZM2G137358_T01     (94)  DEIINYIQSLQCQVEFLSMKLEAVNAQAN--QGVEVFPAK
Si037131m             (86)  DEIINYIQSLQCQVEFLSMKLEAVNAHAN--NG-EAFPSK
Si030790m             (74)  DEIINYIQSLQRQVEFLSMKLEAVNAHVN--SATGSFPSK
GRMZM2G008898_T01    (100)  DEIINYIQSLQRQVEFLSMKLEAINAHVS--NATVAFPTK
Solyc04g005130.2.1    (76)  DEIINYVQSLQRQVEFLSMKLEAVNTRVT--PTIEGIPTK
Solyc05g006650.2.1    (90)  DEIINYIQSLHQVEFLSMKLEAVNSKM---PSIEGYPSK
Glyma01g04610.1       (70)  DEIINYIQSLQRQVEFLSMKLEAVNSRLA--PRIEVFPPK
AT1G59640.1           (62)  DEIINYIQSLQRQVEFLSMKLEAVNSRMN--PGIEVFPPK
Eucgr.B03392.1        (92)  DEIINYIQSLHQVEFLSMKLEAVNSRMN--PPIEVFSSK
POPTR_0008s19510.1    (80)  DEIINYIQSLQRQVEFLSMKLEAVNLMN--PETEVFPSK
POPTR_0010s04920.1    (68)  DEIINYIQSLQRQVEFLSMKLEAVNTRMN--PGIEVFASK
Glyma04g34660.1       (64)  DEIINYIQSLQRQVEFLSMKLEAVNSRMNTNPTIDGFPSK
Glyma06g20000.1       (66)  DEIINYIQSLQRQVEFLSMKLEAVNSRMNMNPTIDGFPSK
Glyma05g01590.1       (88)  DEIINYVQSLQRQVEFLSMKLEAVSSRLSMKPTLECFPSK
Glyma17g10290.1       (78)  DEIINYIQSLHQVEFLSMKLEAVNSRLSMSPTIECFPSK
POPTR_0012s07470.1   (102)  DEIINYIQSLQCQVEFLSMKLEAVNSRMSTSPAIEGLHPK
POPTR_0015s07930.1    (98)  DEIINYIQSLQCQVEFLSMKLEAVNSRMNTSPTTEHLHPK
Eucgr.K02908.1        (82)  DEIINYIQSLQNQVEFLSMKLEAVNSRMNINPTIDGFPAK
Eucgr.B00385.1        (96)  DEIINYIQSLHQVEFLSMKLEAVNSRMDMSPAVEGFVPK
Consensus            (512)  DEIINYXQXLQXQVE
```

FIG. 5G

```
AT5G62610.1         (104) DLG--TLPIDVH-RTIYEQQEANETRV---SQPEWLHMQV
LOC_Os07g09590.1     (72) DFG--AQPYNTAAGLTFDPQTTREFAQG--STSEWLHMQI
LOC_Os03g58830.1     (84) DFG--AQVYNTAPGLTFDPQTPREYAQGS-TPSEWLHMQI
GRMZM2G137358_T01    (94) DYG--SQTYNTAPGLTFDTQTSREYAQGT-STSEWLHMQI
Si037131m            (86) DFA--AQTYNTAPGLTFDTQTPREYAQGT-SASEWLHMQI
Si030790m            (74) DFDAPAPPYSTAPGLTFDPHTPREYPQA--LTSDWLHMQI
GRMZM2G008898_T01   (100) DFG--VAPYNTAPSLTLDPQTPREYAQG--SMSDWLHMQV
Solyc04g005130.2.1   (76) DFG--QQTFETN-AMAFGSQGTREYAGG--TSPDWLHMQI
Solyc05g006650.2.1   (90) DFG--QQPFDTN-AMAFSSQATREYTRG--TSPDWLHMQL
Glyma01g04610.1      (70) DFD--QQTFDTT-GMPFASQATREYSRG--SSPEWLHMQV
AT1G59640.1          (62) EFG--QQAFENP-EIQFGSQSTREYSRG--ASPEWLHMQI
Eucgr.B03392.1       (92) EFG--QQPYDTG-GMPFGSQAPREYSRG--SSPDWLHMQV
POPTR_0008s19510.1   (80) DFG--QHTFDTA-GMAFGSQATREYNHC--TSPEWLHMQV
POPTR_0010s04920.1   (68) DFG---QTFDTA-GMAFGSQATREYSRG--TSPEWLHMQV
Glyma04g34660.1      (64) DVG--TQPFDIA-GMVFGSQAARGYAQGS-SHPGWLHMQI
Glyma06g20000.1      (66) DVG--TQPFDIA-GMVFGSQAARGYAQGS-SPPGWLHMQI
Glyma05g01590.1      (88) EVC--TQA-----GIIFGSQPAKGYAQG--SQMGWLHMQI
Glyma17g10290.1      (78) EVG--TQPFDLA-GIIFGSQPARGYAQG--SQPGWLHMQI
POPTR_0012s07470.1  (102) DLG--AQPFDAT-GMIFGPQPTRDYVQG--SQPEWLHMQV
POPTR_0015s07930.1   (98) DLG--AQPFVAT-GMISGPQPTREYVQG--SQSEWLHMQV
Eucgr.K02908.1       (82) DLG--GQPFDAT-GVMHASQAARQYSQG--SQSEWLHMQL
Eucgr.B00385.1       (96) DLM--SQHFDGT-GMMFASQAARDYLQGSQAQPDWLHMQT
```

FIG. 5H

| | | |
|---|---|---|
| AT5G62610.1 | (104) | D-GN-FNRTT |
| LOC_Os07g09590.1 | (72) | G-NA-YERVT |
| LOC_Os03g58830.1 | (84) | G-GT-YERVT |
| GRMZM2G137358_T01 | (94) | G-SG-YERVS |
| Si037131m | (86) | G-GGAYERVS |
| Si030790m | (74) | G-NT-YERVT |
| GRMZM2G008898_T01 | (100) | G-NA-YERVT |
| Solyc04g005130.2.1 | (76) | G-GG-FERTT |
| Solyc05g006650.2.1 | (90) | G-GG-FERTT |
| Glyma01g04610.1 | (70) | G-GG-YERAT |
| AT1G59640.1 | (62) | GSGG-FERTS |
| Eucgr.B03392.1 | (92) | G-GG-FDRKI |
| POPTR_0008s19510.1 | (80) | G-GG-FQRTS |
| POPTR_0010s04920.1 | (68) | G-GG-FERTS |
| Glyma04g34660.1 | (64) | G-GG-FETT- |
| Glyma06g20000.1 | (66) | G-GG-FERTT |
| Glyma05g01590.1 | (88) | A-GG-FEKAT |
| Glyma17g10290.1 | (78) | A-GG-FEKAT |
| POPTR_0012s07470.1 | (102) | G-GS-FKRAT |
| POPTR_0015s07930.1 | (98) | G-GS-FERAT |
| Eucgr.K02908.1 | (82) | G-GG-FERPM |
| Eucgr.B00385.1 | (96) | G-GG-FKRET |

FIG. 5I

```
LOC_Os01g24460.1      (132)  ------------------------------MKQTLD---
LOC_Os01g01290.1      (134)  ------------------------------MEQTLD---
LOC_Os01g39850.1      (136)  ------------------------------MEQTLD---
Glyma02g09860.1       (130)  ---------------------------------------
Solyc03g111460.1.1    (114)  ----------------------------MASHSDPVA
Solyc03g111470.1.1    (112)  ----------------------------MASHSDPMA
Solyc02g021330.1.1    (124)  ----------------------------MKNNFDKLV
Solyc03g110840.1.1    (120)  --------------------MSELSNVEKTTMKNNSEKSI
Solyc00g107050.1.1    (126)  ----------------------------MENNSEKST
Solyc03g110850.1.1    (118)  ----------------------------MENNYEKSA
Solyc11g016920.1.1    (122)  ----------------------------MENNSEKSA
Solyc03g111450.1.1    (128)  MENNDQQPMEINQQQPMENNDQQAMEINQQQPMENNDQQP
AT5G27910.1           (106)  ----------------------------MENNNGNNQ
AT5G50490.1           (108)  ----------------------------MENNNNNHQ
AT5G50470.1           (116)  -------------------------MEENNGNNNHYLP
AT5G50480.1           (110)  -------------------------MAENNNNNGDNMN
```

FIG. 9A

```
LOC_Os01g24460.1   (132) VHRSLRPPMPMA-----------------------------
LOC_Os01g01290.1   (134) VPRSLRLPTPKA-----------------------------
LOC_Os01g39850.1   (136) VPRSLRLLAPKA-----------------------------
Glyma02g09860.1    (130) -----------------------------------------
Solyc03g111460.1.1 (114) ANAEVAAAVNAEE----------EVAEATAQPIVNANDYL
Solyc03g111470.1.1 (112) ANVEVATSVNAEAAAAAVNVKAVAVAEATAQPVVNANNYL
Solyc02g021330.1.1 (124) VNATQS-STHPT----------------LAQLNIVKNK--
Solyc03g110840.1.1 (120) VNAAQS-TGYPT-----------------------------
Solyc00g107050.1.1 (126) VNATQSVDAYST----------------MSHLNIEKIE--
Solyc03g110850.1.1 (118) VNAGQS-AAYPM----------------LSPPHLEK-K--
Solyc11g016920.1.1 (122) VNAGQS-DVYSM----------------LALPHLEK-K--
Solyc03g111450.1.1 (128) MEINQQQPVEPLYPGYPFYQMLLHQQHQQLQLQLQQQV--
AT5G27910.1        (106) LPPKG------------------------------------
AT5G50490.1        (108) QPPKD------------------------------------
AT5G50470.1        (116) QPSSSQLPPPPLY----------YQSMPLPSYSLPLPY--
AT5G50480.1        (110) NDNHQQPPSYSQ----------------LPPMASS-----
```

FIG. 9B

```
LOC_Os01g24460.1      (132) -QQQMDEFWRDRQKEIEMTKDFSEHMI-PMARLKKIVSSQ
LOC_Os01g01290.1      (134) -QQQMDEFWRDRQKEIETTKDFSEHAI-PMARLKKIASSQ
LOC_Os01g39850.1      (136) -QQQMDEFWRDRQKEIETTKDFSEHAI-PMARLKKIVSSQ
Glyma02g09860.1       (130) --------------------FKSQQKLPLARIRRMMKSE
Solyc03g111460.1.1    (114) LQQQLRLFWAAQLQEIIQIRDFRGHSL-PISRIKKIMKSD
Solyc03g111470.1.1    (112) LQQQLQLFWAAQLQEIMQIGDFEGHSL-PIFRIKKIMKSD
Solyc02g021330.1.1    (124) -QEQLEMFWTNQRREIENDNEFKNNHLLPPNLIKKLMKTD
Solyc03g110840.1.1    (120) ----LEMFWKSQQSQMENIKDFKDRLLLPPTRIKKIMKKN
Solyc00g107050.1.1    (126) -QEYMEMFWTDQEREMEKIDNFKNNLLVSPNRIKNIMKTN
Solyc03g110850.1.1    (118) -QEKLEMFWTDKRREMENVIDFKSNLLPRIHRIKKIMKTD
Solyc11g016920.1.1    (122) -QEKLEMFWIDKQREMENVIDFKSNLLPSINRIKKIMKTD
Solyc03g111450.1.1    (128) -EEQMRIFWNCQREEIEEMDDFKHHHF-PISRIKRIIKSE
AT5G27910.1           (106) -NEQLKSFWS---KEMEGNLDFKNHDL-PITRIKKIMKYD
AT5G50490.1           (108) -NEQLKSFWS---KGMEGDLNVKNHEF-PISRIKRIMKFD
AT5G50470.1           (116) -SPQMRNYWI---AQMGNATDVKHHAF-PLTRIKKIMKSN
AT5G50480.1           (110) -NPQLRNYWI---EQMETVSDFKNRQL-PLARIKKIMKAD
Consensus             (513)                        XXXXXXXXXXXXXXXX
```

FIG. 9C

```
LOC_Os01g24460.1    (132)  KGNMMMTFDMPAFLSKMCELFVQELAARAWACAQSHNRCI
LOC_Os01g01290.1    (134)  KGNMMMSFDMPAFLSKMCELFVQELAVRAWASAQSHNRCI
LOC_Os01g39850.1    (136)  KGNMMMTFDMPAFLSKMCELFVQELAVRAWASAQSHNRCI
Glyma02g09860.1     (130)  PGVQMISSEIPMLMSKACEIFIQELTFRAWMHAEKNNKSI
Solyc03g111460.1.1  (114)  KEVRMISAESPILLAKACELFIQELTHRSWLKAQECQRQT
Solyc03g111470.1.1  (112)  KEVRMISAESPILLDKACELFIQELTHRSWLKAQECQRRT
Solyc02g021330.1.1  (124)  EDDQMIAAESPVLLAKTCELFIQELTLRSWLNAQEKHQHI
Solyc03g110840.1.1  (120)  EDVRMVAGESPVLLAKACELFIQDLTLRSSIHAQENHRRI
Solyc00g107050.1.1  (126)  KDVRRITSESPVLLAKACDFFIQELTLRSWLNAQENHRRI
Solyc03g110850.1.1  (118)  KDVRMIATESPVLLAKACELFIQELTLRSWFKAEENHRRI
Solyc11g016920.1.1  (122)  KDVRMIATESPVLLAKACELFIQELTLRSWFKTEKNHRRI
Solyc03g111450.1.1  (128)  NNAIKLSAETPILFSKACELFVLELTLRSWFHAQQNNRGS
AT5G27910.1         (106)  PDVTMIASEAPILLSKACEMFIMDLTMRSWLHAQESKRVT
AT5G50490.1         (108)  PDVSMIAAEAPNLLSKACEMFVMDLTMRSWLHAQESNRLT
AT5G50470.1         (116)  PEVNMVTAEAPVLISKACEMLILDLTMRSWLHTVEGGRQT
AT5G50480.1         (110)  PDVHMVSAEAPIIFAKACEMFIVDLTMRSWLKAEENKRHT
Consensus           (513)  XXXXXXXXXPXXXXKXCXXXXXLXXRXXXXXXXXXXX
```

FIG. 9D

```
LOC_Os01g24460.1    (132)  IL------DMDIAEAVASTESY-DFLVDILHNHSVKQKST
LOC_Os01g01290.1    (134)  IL------DTDIAEAIASTESY-DFLVDILHNHREKHKST
LOC_Os01g39850.1    (136)  IL------DTDIAKAIASTESY-DFLVDILHNHRVKHKST
Glyma02g09860.1     (130)  VQ------PCDVAKVIMQTDTM-NFLTEIIPNNLGDFSV-
Solyc03g111460.1.1  (114)  LK------KIDLFTVLKETELF-DFLVDVISMDEPEEEAP
Solyc03g111470.1.1  (112)  LK------KIDFFTTEEEAPTYVPGMLGNIPNH-------
Solyc02g021330.1.1  (124)  LK------KDDVTDVIIQTDNL-DFLLVVVDD--------
Solyc03g110840.1.1  (120)  LK------KDDLTDVIVQTDYF-DFLLDVVHRN-------
Solyc00g107050.1.1  (126)  LK------KKDVTDVIKRNDNL-NFLFDDDVN--------
Solyc03g110850.1.1  (118)  LK------KDDVTDVIMETDTL-DFLLDDDAN--------
Solyc11g016920.1.1  (122)  LK------KDDVTDVIMETDIL-DFLLDDDAD--------
Solyc03g111450.1.1  (128)  LK------KTDFAAAIRRTEVF-DFLADVVPEDEINEVAT
AT5G27910.1         (106)  LQ------KSNVDAAVAQTVIF-DFLDDDIEVKRESVAA
AT5G50490.1         (108)  IR------KSDVDAVVSQTVIF-DFLRDDVPKDEGEPVVA
AT5G50470.1         (116)  LKRSDTLTRSDISAATTRSFKF-TFLGDVVPRD---PSVV
AT5G50480.1         (110)  LQ------KSDISNAVASSFTY-DFLLDVVPKDESIATAD
Consensus           (513)  XXXXXXXXXXXXXXXX
```

FIG. 9E

```
LOC_Os01g24460.1    (132)  PCSS--TKRCRLVDQPSTSHIPHQHLLPQFAPTYTLAIPI
LOC_Os01g01290.1    (134)  PCSTLTTKRCRLVDQPSTSRPPYQHQLPLFAPTYTPAIPI
LOC_Os01g39850.1    (136)  PCSTLTTKRCRLVDQPSTSHMPYQHQLPQFAPTYTPAIPI
Glyma02g09860.1     (130)  -FDAKLKEMCLGVLQETCWLKYKAYLLLQEENIANIAEEN
Solyc03g111460.1.1  (114)  TYVPGMLGNIPNRISYYYSPMGPPA--PPMAPLAPSVRPP
Solyc03g111470.1.1  (112)  -------------IPYCYSPMGPPA--PPMAPLAPSMGPP
Solyc02g021330.1.1  (124)  ----------------------------------------
Solyc03g110840.1.1  (120)  ----------------------------------------
Solyc00g107050.1.1  (126)  ----------------------------------------
Solyc03g110850.1.1  (118)  ----------------------------------------
Solyc11g016920.1.1  (122)  ----------------------------------------
Solyc03g111450.1.1  (128)  GFGP-------GMVGPTVGGGFPYFYPPMGLLAMPGVMPG
AT5G27910.1         (106)  AADP-------VAMPPIDDGEL-----P------------
AT5G50490.1         (108)  AADPVDDVADHVAVPDLNNEEL-----P------------
AT5G50470.1         (116)  TDDP---------VLHPDGEVL-----P------------
AT5G50480.1         (110)  PGF--------VAMPHPDGGGVPQYYYP------------
```

FIG. 9F

```
LOC_Os01g24460.1    (132)  TPSLMPLISQCTPSSFPSLPQEKFPLMAPTPIVNRSMLFI
LOC_Os01g01290.1    (134)  TPSLMPPISHYIPFQYPSLSQEVSTMMASAPIVNRSMLLI
LOC_Os01g39850.1    (136)  TPSLMPPISHYIPFQYPSLSQEVSPMMASAPIVNRSMLLI
Glyma02g09860.1     (130)  EVSLSFTAGFMGNPMMKMDSVSKKKRMLETLWKETKL---
Solyc03g111460.1.1  (114)  APSMGPPAPSMPTSPRGIMGRRAMPWVAP-----------
Solyc03g111470.1.1  (112)  APSMEPPAPSMPAPPRGIMGRRAMPWVTT-----------
Solyc02g021330.1.1  (124)  ----------------------------------------
Solyc03g110840.1.1  (120)  ----------------------------------------
Solyc00g107050.1.1  (126)  ----------------------------------------
Solyc03g110850.1.1  (118)  ----------------------------------------
Solyc11g016920.1.1  (122)  ----------------------------------------
Solyc03g111450.1.1  (128)  GPAMLGVMPGGPAMLGPMPGGPAMPGPMIGGPSMPGP---
AT5G27910.1         (106)  -----------------------PGMVIGTPVCCSL---
AT5G50490.1         (108)  -----------------------PGTVIGTPVCYGL---
AT5G50470.1         (116)  -----------------------PGTVIGYPVFDCN---
AT5G50480.1         (110)  -----------------------PGVVMGTPMVGS----
```

FIG. 9G

| | | |
|---|---|---|
| LOC_Os01g24460.1 | (132) | NNIARGLGLQGNNINAVANNNILDNIVGCSSPAVLASMMN |
| LOC_Os01g01290.1 | (134) | HNIARGLGLQGNNISTFANNNIPDNIIGCSSPAVLASMMS |
| LOC_Os01g39850.1 | (136) | HNIARGLGLQGNNISTFANNNIPDNIVGCSSPTVLASMMS |
| Glyma02g09860.1 | (130) | ---------------------------------------PYLT |
| Solyc03g111460.1.1 | (114) | ---------------------------------------SMHV |
| Solyc03g111470.1.1 | (112) | ---------------------------------------SMHV |
| Solyc02g021330.1.1 | (124) | ---------------------------------------AIDG |
| Solyc03g110840.1.1 | (120) | ---------------------------------------GATD |
| Solyc00g107050.1.1 | (126) | --------------------------------------- |
| Solyc03g110850.1.1 | (118) | ---------------------------------------VTDG |
| Solyc11g016920.1.1 | (122) | ---------------------------------------VAFD |
| Solyc03g111450.1.1 | (128) | ---------------------------------------MIGG |
| AT5G27910.1 | (106) | ---------------------------------------GIHQ |
| AT5G50490.1 | (108) | ---------------------------------------GIHA |
| AT5G50470.1 | (116) | ---------------------------------------GVYA |
| AT5G50480.1 | (110) | ---------------------------------------GMYA |

FIG. 9H

```
LOC_Os01g24460.1    (132)  PALLGPSGAPLNPPNSQSYNCT--MDIINSNDACGSNNSS
LOC_Os01g01290.1    (134)  PALLDVAGASLNPPNSHSICTM---NMINSSDPSGSSIGD
LOC_Os01g39850.1    (136)  PALLEVAGTSLNPPNSHSICTM---NMINSSDPSGSSIGD
Glyma02g09860.1     (130)  P--------LIGLNFIHMWHNQ----RWQNSTTRGDKTSW
Solyc03g111460.1.1  (114)  P--------PPLYPRKFGWYAA----GGNPYLKVMPLLIQ
Solyc03g111470.1.1  (112)  P--------PPLYPRQFGWYAA----GDNPYATRGSSGQG
Solyc02g021330.1.1  (124)  S-----------TPSIVPFYIA----GGNN----------
Solyc03g110840.1.1  (120)  P----------FTPNSVPLYAA----GGSNEEDGNNLDQ-
Solyc00g107050.1.1  (126)  ------------------------------STGGNNGHT
Solyc03g110850.1.1  (118)  S-----------TQNVVPFYVA----EGTMGVHTDNLDHQ
Solyc11g016920.1.1  (122)  V---------------------------------------
Solyc03g111450.1.1  (128)  PAVAVVAPSVYVQPPLQAWQPA-----GDNPNAGGESDGQ
AT5G27910.1         (106)  P-----------QPQMQAWPGAWTSVSGEEEEARGKKGGD
AT5G50490.1         (108)  P-----------HPQM---PGAWT-----EEDATGANGGN
AT5G50470.1         (116)  S-----------PPQMQEWPAV----PGDGEEAAGEIGGS
AT5G50480.1         (110)  P--------------SQAWPAA----AGDGEDDAEDNGGN
```

FIG. 9I

```
LOC_Os01g24460.1    (132) VIVANQANIAPSGHFYPIAL-QSSCSTFLHSNNNDTITAI
LOC_Os01g01290.1    (134) INVANQASLAPSEHFNPAILQESSCPSFLYNNNNDTIVVV
LOC_Os01g39850.1    (136) INVANQASLAPSGRFNPAILRESSCPSFLH-SNNDTIVAI
Glyma02g09860.1     (130) SG--------------------------------------
Solyc03g111460.1.1  (114) MLSGTGTTEALSGMMEPPRLIGYRMISKPSGAIWRSGH--
Solyc03g111470.1.1  (112) SG------DPQSGMMEPPRLIGYRMISKPSGAIWRSGH--
Solyc02g021330.1.1  (124) ----------------------------------------
Solyc03g110840.1.1  (120) ----------------------------------------
Solyc00g107050.1.1  (126) ----------------------------------------
Solyc03g110850.1.1  (118) M---------------------------------------
Solyc11g016920.1.1  (122) ----------------------------------------
Solyc03g111450.1.1  (128) GGIFLLFLRSDEGNVFRRRV--------------------
AT5G27910.1         (106) -D----------GN--------------------------
AT5G50490.1         (108) -G----------GN--------------------------
AT5G50470.1         (116) SG----------GN--------------------------
AT5G50480.1         (110) GG----------GN--------------------------
```

FIG. 9J

```
LOC_Os01g24460.1    (132) LEGVDISDIMHVTSDVDAATKVFSGQEEQHEKETNVEWHH
LOC_Os01g01290.1    (134) PEGVDISGTM----DV--AGLVINGQEEEHERKTNVE---
LOC_Os01g39850.1    (136) PEGVDISGTMDVASDV--AAIVINGQ-EEHERETNVEHHQ
Glyma02g09860.1     (130) ----------------------------------------
Solyc03g111460.1.1  (114) ----------------------------------------
Solyc03g111470.1.1  (112) ----------------------------------------
Solyc02g021330.1.1  (124) ----------------------------------------
Solyc03g110840.1.1  (120) ----------------------------------------
Solyc00g107050.1.1  (126) ----------------------------------------
Solyc03g110850.1.1  (118) ----------------------------------------
Solyc11g016920.1.1  (122) ----------------------------------------
Solyc03g111450.1.1  (128) ----------------------------------------
AT5G27910.1         (106) ----------------------------------------
AT5G50490.1         (108) ----------------------------------------
AT5G50470.1         (116) ----------------------------------------
AT5G50480.1         (110) ----------------------------------------
```

FIG. 9K

```
LOC_Os01g24460.1     (132) QNEIYESIDIRIINATTRDGNKCSISWDELGMADDSLLDN
LOC_Os01g01290.1     (134) QNEIYESIDIGIINASVADGNKCSIRWDELGTADDSLLDK
LOC_Os01g39850.1     (136) QNEIYESIDIGIINASVADDNKYSISWDELGMADDSLLDK
Glyma02g09860.1      (130) ----------------------------------------
Solyc03g111460.1.1   (114) ----------------------------------------
Solyc03g111470.1.1   (112) ----------------------------------------
Solyc02g021330.1.1   (124) ----------------------------------------
Solyc03g110840.1.1   (120) ----------------------------------------
Solyc00g107050.1.1   (126) ----------------------------------------
Solyc03g110850.1.1   (118) ----------------------------------------
Solyc11g016920.1.1   (122) ----------------------------------------
Solyc03g111450.1.1   (128) ----------------------------------------
AT5G27910.1          (106) ----------------------------------------
AT5G50490.1          (108) ----------------------------------------
AT5G50470.1          (116) ----------------------------------------
AT5G50480.1          (110) ----------------------------------------
```

FIG. 9L

```
LOC_Os01g24460.1     (132)  FLEELQVRKDDVSDTRIAFNKDPFLDDAVLSNPSTSNGNK
LOC_Os01g01290.1     (134)  FLEEFQARNDGVLHSGIVLHEDHS----------------
LOC_Os01g39850.1     (136)  FLEEFQVRNDGVLRTGIELHEDPFLGDVMLANPSTSNANK
Glyma02g09860.1      (130)  ----------------------------------------
Solyc03g111460.1.1   (114)  ----------------------------------------
Solyc03g111470.1.1   (112)  ----------------------------------------
Solyc02g021330.1.1   (124)  ----------------------------------------
Solyc03g110840.1.1   (120)  ----------------------------------------
Solyc00g107050.1.1   (126)  ----------------------------------------
Solyc03g110850.1.1   (118)  ----------------------------------------
Solyc11g016920.1.1   (122)  ----------------------------------------
Solyc03g111450.1.1   (128)  ----------------------------------------
AT5G27910.1          (106)  ----------------------------------------
AT5G50490.1          (108)  ----------------------------------------
AT5G50470.1          (116)  ----------------------------------------
AT5G50480.1          (110)  ----------------------------------------
```

FIG. 9M

```
clementine0.9_015262m   (172)  ----MET---------------------------------
Bradi1g78540.1          (168)  MAQEWEA-AMGMELGMGTTPHYAASPAAAAAATMA----A
Bradi3g33200.1          (160)  MASEWEI-AMGVELGMGMG--AYNTTSSAGAAAPM----G
LOC_Os10g40810.1        (154)  MASEWEM-AMGVDLGMGMS--TYHNASGGIAAAPMMGHHG
GRMZM2G110295_T01       (158)  MASEWEMAAMGVELGMGMGGTYHHNASSITTAPTS----S
GRMZM2G101058_T01       (170)  MASEWEM-AMGVELGMGMGGTYHHNASSITTAPMMMSSHP
GRMZM2G113098_T01       (152)  MASEWEM-AMGVELGMGMGTYHYHHNASSITTAPM-----
Si036273m               (156)  MASEWEM-AMGVELGMGMGTYHGHHNASSITTAPM-----
Solyc10g018560.1.1      (150)  ----MDV---------------------------------
Glyma03g27250.1         (166)  ----MDL---------------------------------
Glyma07g14750.1         (148)  ----MDL---------------------------------
Solyc01g090760.2.1      (146)  ----MDV---------------------------------
POPTR_0002s14380.1      (164)  ----MDV---------------------------------
POPTR_0014s05760.1      (162)  ----MDV---------------------------------
AT2G45050.1             (140)  ----MDV---------------------------------
AT3G60530.1             (138)  ----MDV---------------------------------
clementine0.9_018978m   (144)  ----MDI---------------------------------
GSVIVT01018180001       (142)  ----MDL---------------------------------
```

FIG. 11A

```
clementine0.9_015262m  (172) ---------------PEFYIGGYFNAASTNNFSSEKRVVVA
Bradi1g78540.1         (168) PFGHGSAYSHSLPHHYHFYGG--SGAEVADP---------
Bradi3g33200.1         (160) HH-AGGGY--------HFY-GMQPMGAADPS---------
LOC_Os10g40810.1       (154) GGGGGGGYSAAHHHHHHYYGM-PHQAAMGDA---------
GRMZM2G110295_T01      (158) HHSGGAGYSAAHHH--HYYGM-PPVGGDATA---------
GRMZM2G101058_T01      (170) HSHSGGAASYSTPHHHHYYGG---MPPMGDA---------
GRMZM2G113098_T01      (152) SSHHSGGASYSTPHHHHYYGM-PPTGGAGDA---------
Si036273m              (156) SSHHSGGASYSTAHHHHYYGM----PPMGDA---------
Solyc10g018560.1.1     (150) -----------------YGR-----LTPEV---------
Glyma03g27250.1        (166) -----------------YGS---FSTPSDC---------
Glyma07g14750.1        (148) -----------------YGS---FSTPSDC---------
Solyc01g090760.2.1     (146) -----------------YGL----HSAPDL---------
POPTR_0002s14380.1     (164) -----------------YGG--VSTSAPDY---------
POPTR_0014s05760.1     (162) -----------------YGG-LSTTTAPDY---------
AT2G45050.1            (140) -----------------YGL-----SSPDL---------
AT3G60530.1            (138) -----------------YGM-----SSPDL---------
clementine0.9_018978m  (144) -----------------YGLPSNNTTTQDL---------
GSVIVT01018180001      (142) -----------------YGL-----QTSDF---------
```

FIG. 11B

```
clementine0.9_015262m   (172)  ADQKPGENFNFTVEDL---LDFSNDDAIMNDGGFFENVAA
Bradi1g78540.1          (168)  ----------MRVDEM---LDLSS--HLGAHDFFPGGS--
Bradi3g33200.1          (160)  ----------MRVDEL---LDLSS-AGAGAHDFFP-----
LOC_Os10g40810.1        (154)  ----------MRVDDL---LDLSN--TPGAHDFFPASAAA
GRMZM2G110295_T01       (158)  ----------MRVDDLLENLDLST--GAGAHEFFPT----
GRMZM2G101058_T01       (170)  ----------MRVDDL---LDLST-PGAGAHEFFPTA---
GRMZM2G113098_T01       (152)  ----------MRVDDL---LDLSTGAGAGAHEFFPTAPA-
Si036273m               (156)  ----------MRVDEL---LDLST--GAGAHDFFPTAAGA
Solyc10g018560.1.1      (150)  ----------FRIDDF---LDFSN------EEDIFSSSKTA
Glyma03g27250.1         (166)  ----------LHIDDF---LDFSN--------------ITT
Glyma07g14750.1         (148)  ----------LHIDDF---LDFSN----------------
Solyc01g090760.2.1      (146)  ----------FRIDDL---LDFSN------DEIFSINNNS
POPTR_0002s14380.1      (164)  ----------FLIDDL---LDFSN------DDLL------
POPTR_0014s05760.1      (162)  ----------FHIDDL---LDFSN------DDLLSSPS--
AT2G45050.1             (140)  ----------LRIDDL---LDFSN------EDIFSASSSG
AT3G60530.1             (138)  ----------LRIDDL---LDFSN------DEIFSSSSTV
clementine0.9_018978m   (144)  ----------FRIDDL---LDFSN------DELFTSSSSA
GSVIVT01018180001       (142)  ----------FRIDDL---LDFTN------DELFS-----
```

FIG. 11C

```
clementine0.9_015262m  (172) NSTDSSTVTSNSAVSGGENNFP----ANFSGCRSSN----
Bradi1g78540.1         (168) NGAAQGEQAPPPAAPS----------SSDHHGHGHHHSSS
Bradi3g33200.1         (160) AAAADNGHYHYHHLGPG-VGEPSAATTPSATSSDHQ----
LOC_Os10g40810.1       (154) AAAGDHGHHHHHHIGG--MGEPSGA-TPSATSSDHQ----
GRMZM2G110295_T01      (158) AAAANKGHHHS---GGAMVGEP----SPTANSSDHQ----
GRMZM2G101058_T01      (170) APATDKGHHSSGAMGEP---------SPTANSSDHR----
GRMZM2G113098_T01      (152) PATTDKGHHHPGAMGEPS--------PTAANSSDHQ----
Si036273m              (156) AAADNGHH--SGAMGEP---------SPTANSSDHQ----
Solyc10g018560.1.1     (150) IDFDLNHHYQPPPTDS----------IADTGCYYHA----
Glyma03g27250.1        (166) TTTDTHHHFPP--------------PQNSPSISHD----
Glyma07g14750.1        (148) ITTDTHHHLPP--------------PQNSPLISHD---D
Solyc01g090760.2.1     (146) NNTDSNHHHQPHSHNS---------SAAGPANYYD-ALL
POPTR_0002s14380.1     (164) TSSTDHHHLPPPETSSIHHHHHF---FPSPTTYINN---T
POPTR_0014s05760.1     (162) SSIDHHHHLPPPETSSIHHHH-----FPSSTYINNP----
AT2G45050.1            (140) GSTAATSSSSFP-------------PPQNPSFHHHHLPS
AT3G60530.1            (138) TSSAASSAASSENPFS----------FPSSTYTS------
clementine0.9_018978m  (144) ATANTTAIASDTDH------------LPQAQHQSFD---S
GSVIVT01018180001      (142) STTTDSGNLPPPEIASGNRS------LAASGNRDQP---N
```

FIG. 11D

```
clementine0.9_015262m  (172)  SFADSQFCGELCV--PYDDLAELEWLSNFVEDSFSMDQTL
Bradi1g78540.1         (168)  NSFNLSFADEFFVPVPREEAAELEWLSNFVDDSYP---DT
Bradi3g33200.1         (160)  -TSMLSFADEFYI--PSEEAAELEWLSKFVDDSYS---DM
LOC_Os10g40810.1       (154)  -TSMLSFADDFYI--PTEDAAELEWLSKFVDDSYS---DM
GRMZM2G110295_T01      (158)  -TSLLSFADEFYI--PSEEAAELEWLSKFVDDSYS---DM
GRMZM2G101058_T01      (170)  -TSALSFADEFYI--PTEEAAELEWLSKFVDDSYS---DM
GRMZM2G113098_T01      (152)  -TSLLSFADEFYI--PSEEAAELEWLSKFVDDSYS---DM
Si036273m              (156)  -TSLLSFADEFYI--PSEEAAELEWLSKFVDDSYS---DM
Solyc10g018560.1.1     (150)  PPNSVDFTDKLCV--PSDDVAELEWLSNFVEDSSN---NF
Glyma03g27250.1        (166)  PNFFLNFP---SV--PSDEAVELEWLSQFVNDEAT---SF
Glyma07g14750.1        (148)  ANLFFNFP---SV--PTDEAAELEWLSQFVDDDAT---SF
Solyc01g090760.2.1     (146)  PNSSDDFTDNLCV--PSDDVAELEWLSNFVEDSFS---NF
POPTR_0002s14380.1     (164)  SSLSTDFTDHLSV--PSDDVAELEWLSQFMEDSFT---DF
POPTR_0014s05760.1     (162)  SSLSTDFTDHLSV--PTDDVAELEWLSQFVEDSFS---DF
AT2G45050.1            (140)  SADHHSFLHDICV--PSDDAAHLEWLSQFVDDSFA---DF
AT3G60530.1            (138)  PTLLTDFTHDLCV--PSDDAAHLEWLSRFVDDSFS---DF
clementine0.9_018978m  (144)  FNPSSDFTGDLCV--PSDDVAELEWLSQFVDDSCM---DF
GSVIVT01018180001      (142)  TFHSADFTDDLCV--PSDDVAELEWLSNFVDDSFA---DF
Consensus              (514)                 PXXXXXXLEWLSXFXXD
```

FIG. 11E

```
clementine0.9_015262m   (172)  QKSDLEFLSGSKSLTPESSSSSTRLEPVSPKASNPVFLPE
Bradi1g78540.1          (168)  PNYPPAVQAAARNGARQ------------EMLHNNNNPAS
Bradi3g33200.1          (160)  PNYSSAAHAAMAKAAAAASNS--------PAGQHGSCITA
LOC_Os10g40810.1        (154)  PNYQSSAHAAMAAAAASAANNG-------GGSSAGQDSCL
GRMZM2G110295_T01       (158)  PNYSSATHAAMAAAAAAAAAANTAGTRAGGTSGGQDSCA
GRMZM2G101058_T01       (170)  PNYSSATHAAMAAAAAAAANAAGNGG---GTTSAGQDSGV
GRMZM2G113098_T01       (152)  PNYSSAAAHAAMAAAAAGNGG--------GGTSAGQDSCV
Si036273m               (156)  PNYSSHAAMAAAAAANAAGNG--------GGNSGGQDSCV
Solyc10g018560.1.1      (150)  PSNNL------------------------TQTMYHLNNTN
Glyma03g27250.1         (166)  HNIPP------------------------PASIGSHT
Glyma07g14750.1         (148)  HSFPA------------------------TASIGSHSTS
Solyc01g090760.2.1      (146)  PANSV------------------------TGTMNITSNT
POPTR_0002s14380.1      (164)  P----------------------------STINIPTD
POPTR_0014s05760.1      (162)  P----------------------------SIINIPTD
AT2G45050.1             (140)  PANPL------------------------GGTMTSVKTE
AT3G60530.1             (138)  PANPL------------------------TMTVRPE
clementine0.9_018978m   (144)  PANSL------------------------AGTIV--RSD
GSVIVT01018180001       (142)  PENEL------------------------AGTVMA-RPD
```

FIG. 11F

```
clementine0.9_015262m  (172) TPLP-GK-ARSKRPRAA-------PCDWST----RLLHVS
Bradi1g78540.1         (168) TALP-GRGARSKRSRAA----SAAAAAWHALVPRHQEHQR
Bradi3g33200.1         (160) AAPP-GRGARSKRSRAS----AAAAAAWHSLMPRPPSQSS
LOC_Os10g40810.1       (154) TAAP-GRGARSKRSRAT----AAAAAAWHSLVPRPPSQSS
GRMZM2G110295_T01      (158) TAAP-GRGARSKRSSRA-------AAAAWHSLVPRPPSQPS
GRMZM2G101058_T01      (170) AAAP-GRGARSRRSRAT----AAAAAVWHSLVPRPPSQSS
GRMZM2G113098_T01      (152) TAAPAGRGARSKRSSRA------PAAAAWHSLVSRPPSQPS
Si036273m              (156) TAAP-GRGARSKRSRAT----AAAAAAWHSLVPRPPSQSS
Solyc10g018560.1.1     (150) TILH-SK-SRSKRSRNS----NSTSWNTSSLQRHKSANQK
Glyma03g27250.1        (166) TPFL-SNNNRNDNNNEY------PKSSSSSP---------V
Glyma07g14750.1        (148) FLSN-NN-NRNDNNEYP------KSSLSSN----IPCSSA
Solyc01g090760.2.1     (146) ASFH-GR-SRSKRSRST------SSWTSSLQNSNATTSVK
POPTR_0002s14380.1     (164) TSSR-IK-SCSKRSRTT------TTATSSS----ADIETA
POPTR_0014s05760.1     (162) TSFC-NK-SRSKRSRAT-----ATTATSSS----PELETA
AT2G45050.1            (140) TSFP-GK-PRSKRSRAP----APFAGTWSPMPLESEHQQL
AT3G60530.1            (138) ISFT-GK-PRSRRSRAP---APSVAGTWAPMSESELCHSV
clementine0.9_018978m  (144) TSLS-GR-GRSKRSKATNSAANTTTWNWTS-------SES
GSVIVT01018180001      (142) SSFP-GR-TRSKRSRAS-----STNKVWTS----SSSSSV
```

FIG. 11G

```
clementine0.9_015262m   (172)  PKGPSVERES--------------------------PN
Bradi1g78540.1          (168)  PSPSSSSSSS-----------------DQQQLVSSSKP
Bradi3g33200.1          (160)  PSSSSCSSSDI--PASSNKP---ARPNN-SNGSRGKKQGP
LOC_Os10g40810.1        (154)  P-SSSCSSSDF---PSSNKPSGTARPNGSGGGSRGKKSPG
GRMZM2G110295_T01       (158)  P-STSCSSSDFTPASTNNKP---ARPSN-G-GSRGRKSPG
GRMZM2G101058_T01       (170)  PSSSSCSSSDF---PSSNKP---ARPNG---GSRGKKVPG
GRMZM2G113098_T01       (152)  PSSSSCSSSDF---PSSSN-----RP------ARGRKSPG
Si036273m               (156)  P-SSSCSSSDF---PSSNKP---GRPNG-ANGSRGKKSPG
Solyc10g018560.1.1      (150)  NSNQDENSGD------------------------YNSN
Glyma03g27250.1         (166)  LAGKSRARRE-----------------------------
Glyma07g14750.1         (148)  VAGKSRARRE-----------------------------
Solyc01g090760.2.1      (146)  NKESSVYTRE-----------------------------
POPTR_0002s14380.1      (164)  VTGESRVKKE------------------------NNGA
POPTR_0014s05760.1      (162)  VTGKSRLKKE------------------------NNGA
AT2G45050.1             (140)  HSAAKFKPKK-----------------EQSGGGGGGGG
AT3G60530.1             (138)  AKPKPKKVYN-----------------------------
clementine0.9_018978m   (144)  ESGNSKQKRE--------------------NHRQSSPI
GSVIVT01018180001       (142)  ISGERSSSSS------------------------PASS
```

FIG. 11H

```
clementine0.9_015262m    (172)  P----LMHTESG---DSVRKCLHCASEKTPQWRTGPMGPK
Bradi1g78540.1           (168)  ARPKAELGSEEQ---GGVRRCTHCASEKTPQWRTGPLGPK
Bradi3g33200.1           (160)  P----VADQSVGLVEGGVRRCTHCASEKTPQWRTGPLGPK
LOC_Os10g40810.1         (154)  P-----AGAEVGME-AGVRRCTHCASEKTPQWRTGPLGPK
GRMZM2G110295_T01        (158)  P--AGEVVA-VGVE-GGVRRCTHCASETTPQWRTGPLGPK
GRMZM2G101058_T01        (170)  PPGGGPAGGEAGLEGGGVRRCTHCASEKTPQWRTGPLGPK
GRMZM2G113098_T01        (152)  P--GGDAVA--GSD-GGVRRCTHCASEKTPQWRTGPLGPK
Si036273m                (156)  P--GGAAGAEVGME-GGVRRCTHCASEKTPQWRTGPLGPK
Solyc10g018560.1.1       (150)  K----LSNNSKI---ITSRKCTHCASEKTPQWRTGPLGPK
Glyma03g27250.1          (166)  -------GSVTG---DGVRRCSHCATDKTPQWRTGPLGPK
Glyma07g14750.1          (148)  -------GSVTGD--GGVRRCSHCASEKTPQWRAGPLGPK
Solyc01g090760.2.1       (146)  -----RSSSMDE---DVPRRCTHCASEKTPQWRTGPLGPK
POPTR_0002s14380.1       (164)  P----HSSAETE---GGARRCTHCASEKTPQWRTGPLGPK
POPTR_0014s05760.1       (162)  P----HSPAEE----GTVRRCTHCASEKTPQWRTGPLGPK
AT2G45050.1              (140)  RHQSSSSETTEG---GGMRRCTHCASEKTPQWRTGPLGPK
AT3G60530.1              (138)  ------AESVTA---DGARRCTHCASEKTPQWRTGPLGPK
clementine0.9_018978m    (144)  P----------E---GGVRRCTHCASEKTPQWRTGPLGPK
GSVIVT01018180001        (142)  P-------------TGARKCTHCASEKTPQWRTGPLGPK
Consensus                (515)                    RXCXHCAXXXTPQWRXGPXGPK
```

FIG. 11I

```
clementine0.9_015262m   (172)  TLCNACGVRYKSGRLVPEYRPAASPTFVSAKHSNSHRKVM
Bradi1g78540.1          (168)  TLCNACGVRYKSGRLVPEYRPAASPTFVLTQHSNSHRKVM
Bradi3g33200.1          (160)  TLCNACGVRFKSGRLVPEYRPAASPTFLLTQHSNSHRKVM
LOC_Os10g40810.1        (154)  TLCNACGVRFKSGRLMPEYRPAASPTFVLTQHSNSHRKVM
GRMZM2G110295_T01       (158)  TLCNACGVRFKSGRLVPEYRPASSPTFVLTQHSNSHRKVM
GRMZM2G101058_T01       (170)  TLCNACGVRFKSGRLMPEYRPAASPTFVLTQHSNSHRKVM
GRMZM2G113098_T01       (152)  TLCNACGVRFKSGRLVPEYRPAASPTFVLTQHSNSHRKVM
Si036273m               (156)  TLCNACGVRFKSGRLMPEYRPAASPTFVLTQHSNSHRKVM
Solyc10g018560.1.1      (150)  TLCNACGVRYKSGRLVPEYRPAASPTFVLTQHSNSHRKVM
Glyma03g27250.1         (166)  TLCNACGVRFKSGRLVPEYRPAASPTFVMTQHSNSHRKVM
Glyma07g14750.1         (148)  TLCNACGVRFKSGRLVPEYRPAASPTFVLTQHSNSHRKVM
Solyc01g090760.2.1      (146)  TLCNACGVRYKSGRLVPEYRPAASPTFVLTQHSNSHRKVM
POPTR_0002s14380.1      (164)  TLCNACGVRYKSGRLVPEYRPAASPTFVLTQHSNSHRKVL
POPTR_0014s05760.1      (162)  TLCNACGVRYKSGRLVPEYRPAASPTFVLTRHSNSHRKVL
AT2G45050.1             (140)  TLCNACGVRFKSGRLVPEYRPASSPTFVLTQHSNSHRKVM
AT3G60530.1             (138)  TLCNACGVRYKSGRLVPEYRPASSPTFVLTQHSNSHRKVM
clementine0.9_018978m   (144)  TLCNACGVRYKSGRLVPEYRPASSPTFVLTQHSNSHRKVL
GSVIVT01018180001       (142)  TLCNACGVRYKSGRLVPEYRPAASPTFVLTQHSNSHRKVM
Consensus               (515)  TLCNACGVRXKSGRLXPEYRPAXSPTFXXXXHSNSHRKVX
```

FIG. 11J

```
clementine0.9_015262m    (172) ELRRQKE-MQRAPQQQFLGQRSIF---GVSN------GAD
Bradi1g78540.1           (168) ELRRQNEQLVHIRGG------------AAAG------SPS
Bradi3g33200.1           (160) ELRRQKE-IVLIRGSHP----------SVPT------GPA
LOC_Os10g40810.1         (154) ELRRQKE-LLIIRGSHRDAAAAAAAAAAAAA------AGS
GRMZM2G110295_T01        (158) ELRRQKE-LVLIRGTHR----------DASA------AAA
GRMZM2G101058_T01        (170) ELRRQKE-LILIRGSHR----------DAA-------AGS
GRMZM2G113098_T01        (152) ELRRQKE-LILIRGSHR----------DAAAA-----AGA
Si036273m                (156) ELRRQKE-LILIRGSHR----------DAAAAAAASAAA
Solyc10g018560.1.1       (150) ELRRQKE-IIDQQQQHG-----------------------
Glyma03g27250.1          (166) ELRRQKE-LLRHQQQEQ-----------------------
Glyma07g14750.1          (148) ELRRQKE-LLRHQQQQQ---------------------LQ
Solyc01g090760.2.1       (146) ELRRQKE-MIHQPQQQQ----------QMPP------STE
POPTR_0002s14380.1       (164) ELRRQKEMMLRQQQQHG-----------------------
POPTR_0014s05760.1       (162) ELRRQKE-MTVGRQQQQ-----------------------
AT2G45050.1              (140) ELRRQKE-VMRQPQQVQ-----------------------
AT3G60530.1              (138) ELRRQKE----QQESCV----------RIPP---------
clementine0.9_018978m    (144) ELRRQKE-LLRQQQLQQ----------QQQQ------EEG
GSVIVT01018180001        (142) ELRRQKE-ILRQQQQQQ-----------------------
Consensus                (515) ELRRQXE
```

FIG. 11K

```
clementine0.9_015262m   (172)  DYLIHHPS--GPD-------FRHMI
Bradi1g78540.1          (168)  SGSAASGEHMFRD-------YGVC-
Bradi3g33200.1          (160)  GAATVKPELLFRD-------YGIC-
LOC_Os10g40810.1        (154)  AAATGRPELMFRD-------YGVC-
GRMZM2G110295_T01       (158)  GSAG--PELMFRD-------YGVC-
GRMZM2G101058_T01       (170)  AAGGPRPELMFRD-------YGVC-
GRMZM2G113098_T01       (152)  GSAGPRPELMFRD-------YGVC-
Si036273m               (156)  GSAGPRPELMFRD-------YGVC-
Solyc10g018560.1.1      (150)  --MYGHH-------------YPVC-
Glyma03g27250.1         (166)  -----CYRHTHHD-------FKVC-
Glyma07g14750.1         (148)  QEQCHRHTHNHHD-------FKVC-
Solyc01g090760.2.1      (146)  EGMYGHH-------------FRVC-
POPTR_0002s14380.1      (164)  ----------YQG-------YEVC-
POPTR_0014s05760.1      (162)  ------QQHGYQG-------YEVC-
AT2G45050.1             (140)  ---LHHHHHPF--------------
AT3G60530.1             (138)  -------------------FQPQ-
clementine0.9_018978m   (144)  QGQIYRHQ---RD-------FEVC-
GSVIVT01018180001       (142)  --QLYHHHHDFEEVSLNFLFFALML
```

FIG. 11L

```
LOC_Os04g56780.1      (188) -MDHMQQQ----QRQQVGGGGGEEVAGRGGV------PVC
Si024219m             (194) -MAANVGG------KSVVGGGAGAGGTTGGGA-----AAC
GRMZM2G028622_T01     (202) -MAANAGG-----------GGAGGGSGSGSVAAP---AVC
GRMZM2G047448_T01     (196) -MAANVGA-----GRSAGGGGAGTGTGTAAGSGGVSTAVC
AT2G17950.1           (174) -MEPPQHQHHHHQADQESGNNNNNKSGSGG-------YTC
Eucgr.J02429.1        (176) -MEPQQQQ-QQQHQNQEDMNCSNNNGKGGGTSSSSSYAC
clementine0.9_033636m (184) -MEPQQQQ------NQHQGNGACGGSGKGNN------CHC
Solyc02g083950.2.1    (186) -MEHQHNI-----------EDGGKNSNNS-------FLC
POPTR_0005s11680.1    (190) -MEPQQQQ----HQNQQQPNEDNNGGAKGN-------FIC
POPTR_0005s11680.2    (192) -MEPQQQQ----HQNQQQPNEDNNGGAKGN-------FIC
POPTR_0007s14130.1    (198) -MEPHQQQ----------PNEDNNGGAKGN-------FLC
POPTR_0007s14130.2    (200) -MEPHQQQ----------PNEDNNGGAKGN-------FLC
GSVIVT01018787001     (182) -MEPQQQLQQQQQQNQQQPNEDS-GSSKGS-------FLC
Glyma01g37190.1       (178) MMEPQQQQQQAQGSQQQQQNEDG-GSGKGG-------FLS
Glyma11g08090.1       (180) -MEPQQQQ----GSQQQQQNEDAGGSGKGG-------FLS
```

FIG. 13A

```
LOC_Os04g56780.1       (188)  RPSGTRWTPTTEQIKILRELYYSCGIRSPNSEQIQRIAAM
Si024219m              (194)  RASGSRWTPTPEQIRILKELYYGCGIRSPNSEQIQRITAM
GRMZM2G028622_T01      (202)  RPSGSRWTPTPEQIRMLKELYYGCGIRSPSSEQIQRITAM
GRMZM2G047448_T01      (196)  RPSGSRWTPTPEQIRILKELYYGCGIRSPNSEQIQRITAM
AT2G17950.1            (174)  RQTSTRWTPTTEQIKILKELYYNNAIRSPTADQIQKITAR
Eucgr.J02429.1         (176)  RQSSTRWTPTTDQIRILKDLYYNYGVRSPTADQIQRISAR
clementine0.9_033636m  (184)  RPTCPRWTPTTDQIRILKELYYNNGVRSPTAEQIQKISAR
Solyc02g083950.2.1     (186)  RQSSSRWTPTSDQIRILKDLYYNNGVRSPTAEQIQRISAK
POPTR_0005s11680.1     (190)  RQTSTRWTPTTDQIRILKELYYIKGVRSPNGAEIQQISAR
POPTR_0005s11680.2     (192)  RQTSTRWTPTTDQIRILKELYYIKGVRSPNGAEIQQISAR
POPTR_0007s14130.1     (198)  RQTSTRWNPTTDQIRILKELYYIKGVRSPNGAEIQQISAR
POPTR_0007s14130.2     (200)  RQTSTRWNPTTDQIRILKELYYIKGVRSPNGAEIQQISAR
GSVIVT01018787001      (182)  RQSSTRWTPTTDQIRILKDLYYNNGVRSPSAEQIQRISAR
Glyma01g37190.1        (178)  RQSSTRWTPTNDQIRILKELYYNNGIRSPSAEQIQRISAR
Glyma11g08090.1        (180)  RQSSTRWTPTNDQIRILKDLYYNNGIRSPSAEQIQRISAR
Consensus              (516)  XXXRWXPTXXQIXXLXXLYYXXXXRSPXXXXIQXIXAX
```

FIG. 13B

```
LOC_Os04g56780.1      (188)  LRQYGRIEGKNVFYWFQNHKARERQKKRL---TT------
Si024219m             (194)  LRQHGKIEGKNVFYWFQNHKARERQKRRL---TN------
GRMZM2G028622_T01     (202)  LRQHGKIEGKNVFYWFQNHKARERQKRRL---TS------
GRMZM2G047448_T01     (196)  LRQHGKIEGKNVFYWFQNHKARERQKRRL---TN------
AT2G17950.1           (174)  LRQFGKIEGKNVFYWFQNHKARERQKKRF-NGTNMTTPSS
Eucgr.J02429.1        (176)  LRQYGKIEGKNVFYWFQNHKARERQKKRF-----------
clementine0.9_033636m (184)  LRQYGKIEGKNVFYWFQNYKARERLKKKI-EGSS------
Solyc02g083950.2.1    (186)  LRQYGKIEGKNVFYWFQNHKARERQKKRLIAAAS------
POPTR_0005s11680.1    (190)  LRKYGKIEGKNVFYWFQNHKARERQKKRF---TN------
POPTR_0005s11680.2    (192)  LRKYGKIEGKNVFYWFQNHKARERQKKRF---TN------
POPTR_0007s14130.1    (198)  LRKYGKIEGKNVFYWFQNHKARERQKKRL---TN------
POPTR_0007s14130.2    (200)  LRKYGKIEGKNVFYWFQNHKARERQKKRL---TN------
GSVIVT01018787001     (182)  LRQYGKIEGKNVFYWFQNHKARERQKKRF---TT------
Glyma01g37190.1       (178)  LRQYGKIEGKNVFYWFQNHKARERQKKRF---TS------
Glyma11g08090.1       (180)  LRQYGKIEGKNVFYWFQNHKARERQKKRF---TF------
Consensus             (516)  LRXXGXIEGKNVFYWFQNXKARERXKX
```

FIG. 13C

```
LOC_Os04g56780.1      (188) ----------------L--DVTTTTAAAA-----DADA--
Si024219m             (194) ----------------L--DVNVPAAAAA-----DV----
GRMZM2G028622_T01     (202) ----------------L--DVNVPAAGAA-----DATT--
GRMZM2G047448_T01     (196) ----------------L--DVNVPVAADD-----SA----
AT2G17950.1           (174) SPNSVMMAANDHYHPLLHHHHGVPMQRPA----NSVNVKL
Eucgr.J02429.1        (176) ----------------------------------FSP--
clementine0.9_033636m (184) ----------------TSAADNLPMHQRP-AAATNWKP--
Solyc02g083950.2.1    (186) ----------------ATDNNNISSMQMI---PHLWRSP-
POPTR_0005s11680.1    (190) ----------------D-----VPTQQRT-----TLKP--
POPTR_0005s11680.2    (192) ----------------D-----VPTQQRT-----TLKP--
POPTR_0007s14130.1    (198) ----------------E-----VPMQQRT-----AWKP--
POPTR_0007s14130.2    (200) ----------------E-----VPMQQRT-----AWKP--
GSVIVT01018787001     (182) ----------------D-----MPMQRSL--GNAGWRPD-
Glyma01g37190.1       (178) ----------------DHNHNNVPMQRPPTNPSAAWKPDL
Glyma11g08090.1       (180) ----------------DHNNNNVPMQQRP-----------
```

FIG. 13D

```
LOC_Os04g56780.1     (188)  -SHLAVLSLS---PT--A--AGATAPSFP-GFYV----GN
Si024219m            (194)  -GHLGVLSLS---SP-----SGAAPPSSPLGLYP----GN
GRMZM2G028622_T01    (202)  -SQLGVLSLS---SP----PSGAAPPSPTLGFYAA---GN
GRMZM2G047448_T01    (196)  -HRLGVLSLS---PS--SGCSGAAPPSPTLGFYAG-----
AT2G17950.1          (174)  NQDHHLYHHNKPYPSFNNGNLNHASSGTECGVVN----AS
Eucgr.J02429.1       (176)  -DPNSNIN-------------GTAAPPPTASVVN-PQTRG
clementine0.9_033636m (184) -EDFANKSRS---QS--ITSAGVSATLPSYSVYTGGQMGD
Solyc02g083950.2.1   (186)  -DDHHKYNTT---TT--NPGVQCPSPSSH-GVLPVVQTGN
POPTR_0005s11680.1   (190)  -EDYYSYKYS---GSNNNPGFSSASSSSNTGAVTVGQADN
POPTR_0005s11680.2   (192)  -EDYYSYKYS---------GFSSASSSSNTGAVTVGQADN
POPTR_0007s14130.1   (198)  -EDYYSYKYS---NSNNNPGFSSASSSANTGVVTVGQTDS
POPTR_0007s14130.2   (200)  -EDYYSYKYS---NR-----FSSASSSANTGVVTVGQTDS
GSVIVT01018787001    (182)  -DPIHNKFHT---IP--TPGISSPSSSSSPSVLAVGQMGS
Glyma01g37190.1      (178)  ADPIHTTKYC---NI--SSTAGISSASSSVEMVTVGQMGN
Glyma11g08090.1      (180)  --------------------PTHPNPS-------------
```

FIG. 13E

```
LOC_Os04g56780.1      (188) GGAVQTDQANVVNWDCT--AMAAEKTFLQDYMGVS----G
Si024219m             (194) GGASALQLDTSSDWGST-TAVATETCFLQDYMGVMRSTAG
GRMZM2G028622_T01     (202) GGGSAGLLDTSSDWGSSGAAMATETCFLQDYMGVT----D
GRMZM2G047448_T01     (196) GNGSAVMLDTSSDWGSA-AAMATEACFMQDYMGVM----G
AT2G17950.1           (174) NGYMSSHVYGSMEQDCS-----------MNYNNV------
Eucgr.J02429.1        (176) GGRG------------------------------------
clementine0.9_033636m (184) HGYGPVTM-EKNFRDCSISSTGSSVVGGSRSQ--------
Solyc02g083950.2.1    (186) YGYGTLAM-EKSFRECSISPPG------GSYHQ-------
POPTR_0005s11680.1    (190) YGYGSVTMQEKKNWDCSVPAGG------ESMNNI------
POPTR_0005s11680.2    (192) YGYGSVTMQEKKNWDCSVPAGG------ESMNNI------
POPTR_0007s14130.1    (198) HGYGSVTMQEKNSWDCSAPAGGSNGAGSGSMSNI------
POPTR_0007s14130.2    (200) HGYGSVTMQEKNSWDCSAPAGGSNGAGSGSMSNI------
GSVIVT01018787001     (182) FGYGSV---ERSFTDCSISAGGGRGGVGGSINQ-------
Glyma01g37190.1       (178) YGYGSVPM-EKSFRDCSISAGGSSGHVGLINH--------
Glyma11g08090.1       (180) ----------------------------------------
```

FIG. 13F

```
LOC_Os04g56780.1      (188) V--GCAAGAAPTPWAMTTT----------------TREPE
Si024219m             (194) HHDSSAGGAAASPWACFSSPDS------WAAAPAMTRAPE
GRMZM2G028622_T01     (202) TGS-------SSQWPCFSSSDTIMAAAAAAARVATTRAPE
GRMZM2G047448_T01     (196) G---------ASPWACSSSSSEDPMAALALAP-KVTRAPE
AT2G17950.1           (174) ----------GGGWANMDHHYS----------------SA
Eucgr.J02429.1        (176) ----------SGGWSGKLPPPE-----------------E
clementine0.9_033636m (184) ----------NYGW-VGIDPHT-----------------S
Solyc02g083950.2.1    (186) ----------NLTW-VGVDPYN----------NMSTTSPA
POPTR_0005s11680.1    (190) ----------NYGSRGGIYPYS-----------------S
POPTR_0005s11680.2    (192) ----------NYGSRGGIYPYS-----------------S
POPTR_0007s14130.1    (198) ----------NYGSGVDINSHS-----------------S
POPTR_0007s14130.2    (200) ----------NYGSGVDINSHS-----------------S
GSVIVT01018787001     (182) ----------SFEW-VGMDPYS-----------------S
Glyma01g37190.1       (178) ----------NLGW-VGVDPYN------------------
Glyma11g08090.1       (180) ----------ASAW--------------------------
```

FIG. 13G

```
LOC_Os04g56780.1      (188) TLPLFPVV-----------------FVGGDGAHRHAVHGG
Si024219m             (194) TLPLFPTGDNVQPPRPRRG------APAGDAIRGGGGSG
GRMZM2G028622_T01     (202) TLPLFPTCGDDDDDDSQPPPRPRHAVPVPAGETIRGGGGS
GRMZM2G047448_T01     (196) TLPLFPTGGGGDDRQPPRP------RQSVPAGEAIRGGSS
AT2G17950.1           (174) PYNFFDRAKPLFGLEGHQ-------EEEECGGDAYLEHRR
Eucgr.J02429.1        (176) PFVLHNKFSNLT-------------PPGLCSSSAAAAGVM
clementine0.9_033636m (184) SYIFFGQKNSADGNQGND-------KEDEEDEENGHPGIE
Solyc02g083950.2.1    (186) TYPFLEKSNNKHYEETLDE------EQEEENYQRGNSALE
POPTR_0005s11680.1    (190) SYTVFD-------------------QDQEAAEKIE
POPTR_0005s11680.2    (192) SYTVFD-------------------QDQEAAEKIE
POPTR_0007s14130.1    (198) SYAVFG-------------------QEQEAAAKIE
POPTR_0007s14130.2    (200) SYAVFG-------------------QEQEAAAKIE
GSVIVT01018787001     (182) SYALFDKRKTMGE------------SFEEEQEEEATPEIE
Glyma01g37190.1       (178) ----------------------------------------
Glyma11g08090.1       (180) -------------------------------KPD------
```

FIG. 13H

```
LOC_Os04g56780.1      (188) FPSNFQRWGSAA-----ATSNTITV--QQH------LQQH
Si024219m             (194) YLPTLPFWGAAATAATATTTTTSVTIQQQHHQLLQLQDQY
GRMZM2G028622_T01     (202) SSSYLPFWGAGAASTTAGATSSVAI--QQQ---HQLQEQY
GRMZM2G047448_T01     (196) SSSYLPFWGAAP--TPTGSATSVAI--QQQHQLMQMQEQY
AT2G17950.1           (174) TLPLFPMHGEDH----------------------------
Eucgr.J02429.1        (176) AVGQMGGYGYGS----VTMEKNFRV-----------SKE
clementine0.9_033636m (184) TLPLFPMHGEDS-------INDYWN--SKP-------NSS
Solyc02g083950.2.1    (186) TLSLFPMHEENI-------ISNFCI-----------KHH
POPTR_0005s11680.1    (190) TLPLFPMHGEDI-------STSFNI--NNV-------NPD
POPTR_0005s11680.2    (192) TLPLFPMHGEDI-------STSFNI--NNV-------NPD
POPTR_0007s14130.1    (198) TLPLFPMLGEDI-------SSSFNI--NNI-------NPD
POPTR_0007s14130.2    (200) TLPLFPMLGEDI-------SSSFNI--NNI-------NPD
GSVIVT01018787001     (182) TLPLFPMHAEDI--------TGFCN--IKP-------ESD
Glyma01g37190.1       (178) ----------------------------------------
Glyma11g08090.1       (180) -----PIHTKLT------------------------KPT
```

FIG. 13I

```
LOC_Os04g56780.1      (188) NFYSSSS--SQLHSQDGPAAGTSLELTLSSYYCSCSPYPA
Si024219m             (194) SFYTTNSQPPSSHDASS-AATASLELSLSSW---CSPYPA
GRMZM2G028622_T01     (202) SFYSNSTQLAGTGSQDVSASAAALELSLSSW---CSPYPA
GRMZM2G047448_T01     (196) SFYSNAQLLPGTGSQD--AAATSLELSLSSW---CSPYPA
AT2G17950.1           (174) --INGGSGAIWKYGQSEVRPCASLELRLN-----------
Eucgr.J02429.1        (176) ALF-NWYG----------AIFILMEGINQTYLCMK-----
clementine0.9_033636m (184) SYYSGWYGSND-GSST--SSSASLELSLNSYTGSSSGSI-
Solyc02g083950.2.1    (186) ESSGGWYHSDN-------NNLAALELTLNSFP--------
POPTR_0005s11680.1    (190) FYYSSWYGSDDYGNAT--TSRTSLELSLYSYNGQQQDY--
POPTR_0005s11680.2    (192) FYYSSWYGSDDYGNAT--TSRTSLELSLYSYNGQQQDY--
POPTR_0007s14130.1    (198) FYYSSGCYGDYGNDT--SSRTSLDLSLYSYNGQPQDY--
POPTR_0007s14130.2    (200) FYYSSGCYGDYGNDT--SSRTSLDLSLYSYNGQPQDY--
GSVIVT01018787001     (182) AYYSGWYRPADAKT----SSRTSLELSLNSYAGRSPDSP-
Glyma01g37190.1       (178) -----SSTYANFFDKIRPSDQETLEEEAEN----------
Glyma11g08090.1       (180) IY--------------------------------------
```

FIG. 13J

```
LOC_Os04g56780.1        (188)  GSM-
Si024219m               (194)  GTM-
GRMZM2G028622_T01       (202)  AGSM
GRMZM2G047448_T01       (196)  GTM-
AT2G17950.1             (174)  ----
Eucgr.J02429.1          (176)  ----
clementine0.9_033636m   (184)  ----
Solyc02g083950.2.1      (186)  ----
POPTR_0005s11680.1      (190)  ----
POPTR_0005s11680.2      (192)  ----
POPTR_0007s14130.1      (198)  ----
POPTR_0007s14130.2      (200)  ----
GSVIVT01018787001       (182)  ----
Glyma01g37190.1         (178)  ----
Glyma11g08090.1         (180)  ----
```

FIG. 13K

```
GRMZM2G300924_T01    (216)  -MEPVGGD------GGGGRG--RG--RGRSWKGK-GVSSG
GRMZM2G139765_T01    (222)  -MEPMGRD------GGGGHG--RG------WKGK-GVSSG
Si019997m            (218)  -MEPADR-------GGGGRG--RG------WKGK-GVSSG
Bradi3g49810.1       (220)  ----------------------------------------
LOC_Os02g42585.1     (232)  -MDAVDRG------GGGGGGGARG--HGRRWKGK-GVSAA
Bradi5g16450.1       (234)  -MDASGES------GGGGRG--ST---GRR-SGK-GLTPI
LOC_Os04g44670.1     (230)  MDAPSGES------GGGGGG--GG---GRRWKGK-GVTPI
Si012169m            (244)  -MDASSASGESGGGGGAGGG--RG---GRRWKGKGGVTPI
GRMZM2G026926_T01    (242)  -MDASSES------GGAGGG--RG---GRRWKGK-GVTPI
GRMZM2G040664_T01    (238)  -MDASSES----CGGGAGGG--RG---GRRWKGK-GATPI
Solyc07g054220.1.1   (208)  -MATPPEE--------------------------PMEFD
Glyma06g45010.1      (210)  -MANNREKSTKEGVEETHHHKVIGESEGQDWEIEKGKGLD
Glyma12g12270.1      (212)  -EGTQLKV--------------IGESEGQDWEKEKGKRLD
Glyma12g33020.1      (214)  -MAAANSG--KFDVGDETHKNSRKGSESQDWEIEKGKCVD
Glyma13g37450.1      (228)  ----------------------------------------
clementine0.9_009464m (240) -MAAAKNS---SKSEKGVDEATEEMVRSQDWEIDEGKDFD
Eucgr.K00961.1       (224)  -MAAAKNT------GKSRRGVDESQKMTELETGKGDYEFS
POPTR_0013s13920.1   (226)  -MAAAKNNFGKSKKGVVDET--RKMMMEQDWQLDRGKKEA
POPTR_0019s13330.1   (236)  -MDSAKNNTGKSKKGVVDET--QRLAMDQDWQLDRGRKEA
AT2G20880.1          (206)  MATAKNKGKSIRVLGTSEAEKKDEMELEEEFQFSSGKYKD
AT4G28140.1          (204)  -MDFDEELNLCITKGKNVDHSFGG----------------
```

FIG. 15A

| | | |
|---|---|---|
| GRMZM2G300924_T01 | (216) | SAAG----RQLAPVLEDAP-AAALLRPLKKI-RSPDRR-- |
| GRMZM2G139765_T01 | (222) | SAAG----RQLAPVLEDAP-AAALLRPLKKI-RSPDRR-- |
| Si019997m | (218) | SAAG----RQLAPVLEDAP-AAALLRPLKKI-RSPDRR-- |
| Bradi3g49810.1 | (220) | --------MELAPVLEDAP-PAALLRPLKK----PDCR-- |
| LOC_Os02g42585.1 | (232) | ISSSAAETQQPVPVLEDAPAAAALLRPQKKI-RSPDRR-- |
| Bradi5g16450.1 | (234) | QARR--QQQQLAPVLENAS-AAALLRPLKKIGRSPDR--- |
| LOC_Os04g44670.1 | (230) | QPRR-----QLGTVLEDSS--AALLRPLKKIGRSPDR--- |
| Si012169m | (244) | QPRR-----QLAPVMEDAS--AASLRPHKKIGRAPDR--- |
| GRMZM2G026926_T01 | (242) | QPRR----TQLAPVMEDAS--AALLRPLKKIGRAPDR--- |
| GRMZM2G040664_T01 | (238) | QPRR-----QLAPVMEDAS--AALLRPLKKIGRAPDR--- |
| Solyc07g054220.1.1 | (208) | DNTF--ERQQRRPVFEEAS---MSNRRFKKI-KSPER--- |
| Glyma06g45010.1 | (210) | LSSG---RRQWKPVFDDAS---LSHRPLKKI-RSPER--- |
| Glyma12g12270.1 | (212) | LSSG---RRQWKPVFDDAS---VSHRPLKKI-RSPE---- |
| Glyma12g33020.1 | (214) | CSSS--QRRQWKPVFDDVS--ISYNRPFKKI-RSPDRQ-- |
| Glyma13g37450.1 | (228) | -------RRQWKPVFDDAS--ISYNRPLKKI-RSPDRQ-- |
| clementine0.9_009464m | (240) | LSSF-ERRQQWRPVLDEAS---VSQRPLKKI-RSPERH-- |
| Eucgr.K00961.1 | (224) | LDSQ-----QWRPVFGEAS---MSGRPLKKI-RSPERQAS |
| POPTR_0013s13920.1 | (226) | DVSF--ERRQWKPVFGEAS---LMDRPLKKI-CSPERQ-- |
| POPTR_0019s13330.1 | (236) | DISF--ERRQWKPVFGEAS---LSDRPSKKI-RSPERQ-- |
| AT2G20880.1 | (206) | SGPG---SDMW---LGDAS--STSPRSLRKT-RTFDR--- |
| AT4G28140.1 | (204) | ----------------EAS--STSPRSMKKM-KSPSR--- |

FIG. 15B

```
GRMZM2G300924_T01     (216) LNRSLSSL-----------SPAPPS-PDSSSAFNPTPL--
GRMZM2G139765_T01     (222) LNRSLSAL----------SSSAPPS-PDSSSVSNPMS---
Si019997m             (218) LNRSLSAL-----------SSAPPS-PDSSSVSNPMSPPA
Bradi3g49810.1        (220) LHRSVSSL-----------SSAPAS-SGSSSVSDPISPPA
LOC_Os02g42585.1      (232) LQRSISSL-----------SSAPAS-PDSSSVSNPMSPPA
Bradi5g16450.1        (234) LHRTTSTLS-----TTSSSSSAPAS-PRSSSVSNAAV---
LOC_Os04g44670.1      (230) LLRSASSL---------STSSSAPPS-PRSSSASDA-PVRV
Si012169m             (244) FQRSASSL------STTASSSAPPS-PRASAASPTPAES-
GRMZM2G026926_T01     (242) FQRSASSLS-----TT--SSSAPPS-PRSSAAGATSPASL
GRMZM2G040664_T01     (238) FQRSASSL------STSTSSSAPPS-PRATS---------
Solyc07g054220.1.1    (208) ---QSSVQQ-------------PFD-HRNNPTPMAFPPP-
Glyma06g45010.1       (210) ----------------------EN-PNQQQQQPPSSMLS
Glyma12g12270.1       (212) ----------------------PEN-PNQQQQQPSSMLS
Glyma12g33020.1       (214) NTNQSSSS---------------SS-SSSSSSSIPFQPSP
Glyma13g37450.1       (228) ETNQSSSSS---------SSTTPFE-P--SPLSNP-----
clementine0.9_009464m (240) QNPVKFSSSFDYQS----PSISSVS-PASASTLGS-----
Eucgr.K00961.1        (224) FQLSSSSSTHQNQTPFAMPSSVPPT-SASSVGHSPMAPSS
POPTR_0013s13920.1    (226) EQIQSSASL---------AHQLPSCFSVSSSSASTLSLYP
POPTR_0019s13330.1    (236) EQTQSSAYL---------AHQLPPSFSVSSSSASTLSLYP
AT2G20880.1           (206) HNPYLVSSY---------ATPQPPT-TTTCSVS-------
AT4G28140.1           (204) ----------------------PK-PYFQSSSSPYSLEA
```

FIG. 15C

```
GRMZM2G300924_T01      (216)  ----------PSARQIF---LAPE--------ASTAGSPR
GRMZM2G139765_T01      (222)  ---------PPSTRHIFPFAYDPA----PAASTSTAASPR
Si019997m              (218)  T-------SLPSTRHIFPFAYDPAPAASTASTAAAATAPR
Bradi3g49810.1         (220)  VGSSLPYPSPGSTRHIFPFAYDPS----------PAAAPR
LOC_Os02g42585.1       (232)  MSL---PNQPPSSRHIFPFAYDPS---------PGAAAPR
Bradi5g16450.1         (234)  --------SPPSARHIFPYAYEPIIAPAASTTTTHGRSPR
LOC_Os04g44670.1       (230)  ISSSPSSPSPPSARHIFPFAYEAS-------TTTVGGSPR
Si012169m              (244)  --------SPPSARRIFPFAYEPS-------APPVGGAPR
GRMZM2G026926_T01      (242)  --------SPPSARHMFPFAYEPS--------APLGGAPR
GRMZM2G040664_T01      (238)  ----------------------------------------
Solyc07g054220.1.1     (208)  --------PSSSRLVFPFAFDGT--------QQSMESSS
Glyma06g45010.1        (210)  L-------QPPSSRIVFPFAFEGS--------QHPMPFPH
Glyma12g12270.1        (212)  L-------QPPSSRIVFPFAFEGS--------QHPMPFPH
Glyma12g33020.1        (214)  L-------SNPPSRIVFPFAFDGS-------QQHPMQFPH
Glyma13g37450.1        (228)  -------PPSSSRIVFPFAFDGS--------QHPMQFPH
clementine0.9_009464m  (240)  ----------SSSRLVFPFAFDTS--------QQAIQFPQ
Eucgr.K00961.1         (224)  --------SHNSPRLIFPFALEGA--------QHHGQFQQ
POPTR_0013s13920.1     (226)  PSSSPSPMSSSSSRLVFPFAFEGS--------NQPIQCPQ
POPTR_0019s13330.1     (236)  PSLSSSPVSSSSSKLQFPFAFEGS--------NQPVQFHQ
AT2G20880.1            (206)  ---------------FPFYLPPA-------IQNQQRFLH
AT4G28140.1            (204)  ---------------FPFSLDPT-------LQNQQQ---
```

FIG. 15D

```
GRMZM2G300924_T01      (216)  LLPLLQYSSEFQRPMTPPP---------PDQQQLQQMISF
GRMZM2G139765_T01      (222)  LLPLLQYGSVF--QQPLPP--------QQPLQH-QQMISF
Si019997m              (218)  LMPLMQYSSVY--QQPLPP------QQQQPLQH-QQMISF
Bradi3g49810.1         (220)  LLQLLQYSSSLYQQQPLLPQQLQQQQQQTPLQN-QQMISF
LOC_Os02g42585.1       (232)  LLPLLQYSSLY--PQPLLP------QQQSPLQN-QQMISF
Bradi5g16450.1         (234)  LDLHPWPQSSTSVSQPASP---------QPLRH-QQMISF
LOC_Os04g44670.1       (230)  LHPLSWQQSSM--SQPASP----QQQQQQPLQH-QQMISF
Si012169m              (244)  LQLPPWQHSSA--SQPASP-------QQAPLQR-QQMISF
GRMZM2G026926_T01      (242)  LELPPPWQHSPSVSQPASPQQQQQQQAQAPVQRQQQMISF
GRMZM2G040664_T01      (238)  --PAPHSASV---SQPASP------QVQAPMQRQQQIISF
Solyc07g054220.1.1     (208)  PLGAN----AM--PLFHPQ------------QQNQQMISF
Glyma06g45010.1        (210)  PFGTT----NL--PLFRPN-----------LHPTQQMISF
Glyma12g12270.1        (212)  PFGTT----NL--PLFRP------------PLHPTQQMISF
Glyma12g33020.1        (214)  QFGTTNP------PFPHPS----------LQNQQHQMISF
Glyma13g37450.1        (228)  QFGTTT---NS--PFPHPSF----------QNQQHQMISF
clementine0.9_009464m  (240)  QFPTSQLQTPL--PNFHPPI--------QPAQTQQQMISF
Eucgr.K00961.1         (224)  QLGTVPYHAFRPALQLQPP------QNQGQQQQQQQMISF
POPTR_0013s13920.1     (226)  QFRTNP---SL--PIFHPL--------SQVAQNQQQMISF
POPTR_0019s13330.1     (236)  QVGTNP---SS--TIFRPPS-------QVAQNQQQMISF
AT2G20880.1            (206)  PNDPS-----------------------GQRQQQMISF
AT4G28140.1            (204)  ---------QL--GSYVPVLEQRQ---DPTMQGQKQMISF
```

FIG. 15E

```
GRMZM2G300924_T01      (216) GSSQQPRQEFVAAAAATPLFPP--QLVA-PEV----QQQM
GRMZM2G139765_T01      (222) GS-----RQQQFGAAAAPLFPP--QLVAPPEV---QQQML
Si019997m              (218) GGGQHQQPPPQFAAAASPLFPP--QLVA-PEV----QQQM
Bradi3g49810.1         (220) GD-------AQHEAQQPPLIPP--QLMA-PEA--------
LOC_Os02g42585.1       (232) GSSQQQQQQQPQFGAASPLFPP--QFLP-PEE----QQRL
Bradi5g16450.1         (234) GA-------------SSPPYCAA--QSFLVPAE-SAQHQHQ
LOC_Os04g44670.1       (230) GA-------------SPPCSTT--QFVV-PENA--QQQQM
Si012169m              (244) GA--------------PPQFQA--QFFL-PDGSPQHQQQH
GRMZM2G026926_T01      (242) GA--------------PPQYQA--QFLL-PEGA--QQQQH
GRMZM2G040664_T01      (238) GP--------------PTQYQT--PFLL-PEGA--QQQQH
Solyc07g054220.1.1     (208) SP---------QQCLYPPYFAG--ELG--PSQ----NQQQ
Glyma06g45010.1        (210) GS--------QQNMGYPPFLAPESTMPHQHQQHLQQHHQQ
Glyma12g12270.1        (212) LP--------SQNMGYPPFLAP--ESTM-PHEHQQHHHQQ
Glyma12g33020.1        (214) GD-------------SSSLLH---QHHH-HQQQHQQHQQQ
Glyma13g37450.1        (228) G---------------PRFFFTCTSSSS-TTTTASAATSS
clementine0.9_009464m  (240) SA--------HQQQQGFPFFAG--ESML-PHQ---QHQRQ
Eucgr.K00961.1         (224) TS-QQQQQQQQLSLNQPLYNFAGDLS--PLQ---HPQQR
POPTR_0013s13920.1     (226) GQ------NQQHGIAYPPFYAG--GL---PMADHHHHQQ
POPTR_0019s13330.1     (236) GQ------NQQYGIAYPPFFAG--ESALANQQ---QQQQQ
AT2G20880.1            (206) D---------------PQQQVQ--PYVA-QQ---QQQQH
AT4G28140.1            (204) S------------------------PQQQQ-QQQQY
```

FIG. 15F

```
GRMZM2G300924_T01    (216) LLRYWSEALNLSPRGFR----G-GAVPLPPARLYQQLLLR
GRMZM2G139765_T01    (222) LLRYWSEALNLSPRGFRA---GAGAGAVPPA-LYQQLL--
Si019997m            (218) LLRYWSEALNLSPRGFR-------GGAVPPA-LFQQLL--
Bradi3g49810.1       (220) -LRYWSEALNLSPRGVL----G-GLVPVPQS-LFQHLL--
LOC_Os02g42585.1     (232) LLRYWSEALNLSPPGVR-------GGALPPS-LYQHLL--
Bradi5g16450.1       (234) LLRYWSEALNLSPRG---------GPAMPPS-MYQQLLLQ
LOC_Os04g44670.1     (230) LLRYWSEALNLSPRG--------GPGGVPPW-LYQQLL--
Si012169m            (244) LLRYWSEALNLSPRG------GQAAAVLPS--LYQHLV--
GRMZM2G026926_T01    (242) LLRYWSEALNLSPRG------GQAAGVLPS--LYQHLL--
GRMZM2G040664_T01    (238) LLRYWSEALNLSPRG------GQQVAGVLPS-RYQHLL--
Solyc07g054220.1.1   (208) MLRYWNETLNLSPRGRMMMMSRLGQDNRG---YFRPQQVQ
Glyma06g45010.1      (210) LLHYWSDAINLSPRGRMMMMMNRTEGRQ----MLRPQA--
Glyma12g12270.1      (212) LLQYWSDALNLSPRGRMMMMNR--TEGRQ---MLRPQA--
Glyma12g33020.1      (214) LLQYWSDALNLSPRGMLT---RLGPDGRP---LFRLPT--
Glyma13g37450.1      (228) VLE-WR--VESKP-------------------LFSPPT--
clementine0.9_009464m (240) LLQYWSDALNLSPRGRL-MMNRIGPDGRP---LFRPQV--
Eucgr.K00961.1       (224) LLQYWSDALNLSPRGRMMMMNRLGPDGRP---IFRPP---
POPTR_0013s13920.1   (226) LFQYWSDALNLSPRGRMMMMNKLGPDGRP---LFRPPI--
POPTR_0019s13330.1   (236) LFQYWNDALNLSPRGRMMMMNRLGPNGRP---LFRPPI--
AT2G20880.1          (206) LLQYWRDILKLSPSGRMMMMNMLRQESDLP--LTRPPV--
AT4G28140.1          (204) MAQYWSDTLNLSPRGRMMMM------------MSQEAV--
```

FIG. 15G

| | | |
|---|---|---|
| GRMZM2G300924_T01 | (216) | ASSGPP--KLYRGVRQRHWGKWVAEIRLPRNRTRLWLGTF |
| GRMZM2G139765_T01 | (222) | RAP-----KLYRGVRQRHWGKWVAEIRLPRNRTRLWLGTF |
| Si019997m | (218) | RAPGPP--KLYRGVRQRHWGKWVAEIRLPRNRTRLWLGTF |
| Bradi3g49810.1 | (220) | RAPVPA--KLYRGVRQRHWGKWVAEIRLPRNRTRLWLGTF |
| LOC_Os02g42585.1 | (232) | RAPGPP--KLYRGVRQRHWGKWVAEIRLPRNRTRLWLGTF |
| Bradi5g16450.1 | (234) | APPPPPPQKLYRGVRQRHWGKWVAEIRLPRNRTRLWLGTF |
| LOC_Os04g44670.1 | (230) | RVPPPP-QKLYRGVRQRHWGKWVAEIRLPRNRTRLWLGTF |
| Si012169m | (244) | RAPPPP-QKLYRGVRQRHWGKWVAEIRLPRNRTRLWLGTF |
| GRMZM2G026926_T01 | (242) | -RPPPP-QKLYRGVRQRHWGKWVAEIRLPRNRTRLWLGTF |
| GRMZM2G040664_T01 | (238) | RAPPPPLQKLYRGVRQRHWGKWVAEIRLPRDRTRLWLGTF |
| Solyc07g054220.1.1 | (208) | VQPISA-TKLYRGVRQRHWGKWVAEIRLPRNRTRLWLGTF |
| Glyma06g45010.1 | (210) | -QPLNA-TKLYRGVRQRHWGKWVAEIRLPRNRTRLWLGTF |
| Glyma12g12270.1 | (212) | -QPLNA-TKLYRGVRQRHWGKWVAEIRLPRNRTRLWLGTF |
| Glyma12g33020.1 | (214) | -QPINT-TKLYRGVRQRHWGKWVAEIRLPRNRTRLWLGTF |
| Glyma13g37450.1 | (228) | -QRINT-TKLYRGVRQRHWGKWVAEIRLPRNRTRLWLGTF |
| clementine0.9_009464m | (240) | -QPLNT-TKLYRGVRQRHWGKWVAEIRLPRNRTRLWLGTF |
| Eucgr.K00961.1 | (224) | -QPINT-TKLYRGVRQRHWGKWVAEIRLPRNRTRLWLGTF |
| POPTR_0013s13920.1 | (226) | -QPINT-RKLYRGVRQRHWGKWVAEIRLPRNRTRLWLGTF |
| POPTR_0019s13330.1 | (236) | -QPINT-TKLYRGVRQRHWGKWVAEIRLPRNRTRLWLGTF |
| AT2G20880.1 | (206) | -QPFSA-TKLYRGVRQRHWGKWVAEIRKPRNRTRLWLGTF |
| AT4G28140.1 | (204) | -QPYIA-TKLYRGVRQRQWGKWVAEIRKPRSRARLWLGTF |
| Consensus | (517) | KLYRGVRQRXWGKWVAEIRXPRXRXRLWLGTF |

FIG. 15H

| | | |
|---|---|---|
| GRMZM2G300924_T01 | (216) | DTAEDAAMAYDREAFKLRGDNARLNFPDLFLGKGRVGGSG |
| GRMZM2G139765_T01 | (222) | DTAEDAAMAYDREAFKLRGENAKLNFPDLFLGKGRVGGSG |
| Si019997m | (218) | DTAEDAAMAYDREAFKLRGENAKLNFPDLFLGKGRVGGSG |
| Bradi3g49810.1 | (220) | DTAEDAAMAYDREAFKLRGENARLNFPDLFLGKGRAGGSG |
| LOC_Os02g42585.1 | (232) | DTAEDAAMAYDREAFKLRGENARLNFPDLFLGKGRTGGSG |
| Bradi5g16450.1 | (234) | DSAEDAAMAYDREAFKLRGENARLNFPDRFLAKGRAGGSG |
| LOC_Os04g44670.1 | (230) | DTAEDAAMAYDREAFKLRGENARLNFPDRFLGKGRAGGKG |
| Si012169m | (244) | DSAEDAAMAYDREAFKLRGENARLNFPDRFFGKGHAGGSG |
| GRMZM2G026926_T01 | (242) | DSAEDAAMAYDREAFKLRGENARLNFPDRFFGKGYAGGSG |
| GRMZM2G040664_T01 | (238) | DSAEDAAMAYDREAFKLRGENARLNFPDRFFGKGHAGGSG |
| Solyc07g054220.1.1 | (208) | DTAEDAAMAYDREAYKLRGDNAKLNFPEHFIGKDRGETST |
| Glyma06g45010.1 | (210) | DTAEDAAMAYDREAFKLRGENAKLNFPELFLNKDKAEQST |
| Glyma12g12270.1 | (212) | DTAEDAAMAYDREAFKLRGENAKLNFPELFLNKDKAEQST |
| Glyma12g33020.1 | (214) | DTAEDAAMAYDREAFKLRGENARLNFPELFLNKDKKEEQQ |
| Glyma13g37450.1 | (228) | DTAEDAAMAYDREAFKQRGENARLNFPELFFNKDKKEQGE |
| clementine0.9_009464m | (240) | DRAEDAALAYDREAFKLRGENARLNFPELFLNKDKAAVST |
| Eucgr.K00961.1 | (224) | DTAEDAALAYDREAFKLRGENARLNFPELFLNKDKAEESA |
| POPTR_0013s13920.1 | (226) | DTAEDAALAYDREAFKLRGENARLNFPELFLNKDKATSTA |
| POPTR_0019s13330.1 | (236) | DNAEDAALAYDREAFKLRGENAKLNFPELFLNKEKETSTA |
| AT2G20880.1 | (206) | DTAEEAAMAYDREAFKLRGETARLNFPELFLNK------- |
| AT4G28140.1 | (204) | DTAEEAAMAYDRQAFKLRGHSATLNFPEHFVNKESELHDS |
| Consensus | (517) | DXAEXAAXAYDRXAXKXRGXXAXLNFPXX |

FIG. 15I

```
GRMZM2G300924_T01     (216) RTSAAASC--------------SSSAPPTPDDS--HMKQA
GRMZM2G139765_T01     (222) RTSASAAV---------SCSSSSSSAPPTPDEN--HAKQA
Si019997m             (218) RTSASAAA---------SCSSSSSSAPPTPDDT--NTKQA
Bradi3g49810.1        (220) RTSASAAA--------SRSSSSCSSAPPTPDET--RTQQA
LOC_Os02g42585.1      (232) RTSASAAA---------SCSSSSSSAPPTPDES--HTQQA
Bradi5g16450.1        (234) RTSASSAAASASTAAAASCSSSSSSPPQASDEAPFNTQQQ
LOC_Os04g44670.1      (230) RTSVSSSA--A---AAASCSSSSLSPPETPDDA--NTQQQ
Si012169m             (244) RTSATSAA--APTTAAGSGSSSSSSPPQTPDEA--STQQT
GRMZM2G026926_T01     (242) RTSATPAA--APTAAAASGSTSSSSPPQTPDDP--STQQT
GRMZM2G040664_T01     (238) RTGATSAS----------GSTSSSSTPQTPGEQ--NTQQA
Solyc07g054220.1.1    (208) EANSSSIT------------THESSLPEHNSES-------
Glyma06g45010.1       (210) TVAPASSS--------------------------------
Glyma12g12270.1       (212) TAPASSSN--------------------------------
Glyma12g33020.1       (214) QQEQEASS------------------PVLSAI-------
Glyma13g37450.1       (228) EEASSPSN--------------------------------
clementine0.9_009464m (240) DPGSNISS------------------PPSPYESSMPNRLQ
Eucgr.K00961.1        (224) GPSSSSSS------------------PPKDENVITRQYMK
POPTR_0013s13920.1    (226) PSSTVSS-------------------PPTSNQS-LKPKQA
POPTR_0019s13330.1    (236) PSSSVSS-------------------PPTPNQSSMPKQAQ
AT2G20880.1           (206) ----------------------------------------
AT4G28140.1           (204) NSSDQKE-------------------PETPQPS-------
```

FIG. 15J

```
GRMZM2G300924_T01    (216)  --------AQQQQRVRDGEQPCSGEAKPLLPETETERADN
GRMZM2G139765_T01    (222)  -------------QRHDGEQPCNSEAKPLFP--EAEQPNN
Si019997m            (218)  -------------QHHHGEQPFNSEAKPLLP--ETEQAKN
Bradi3g49810.1       (220)  RQALLLREQQQQQQQEHLEEPSDIEPTPLFS-AAEEQEGI
LOC_Os02g42585.1     (232)  ----------QPQPQQPTEESSNTEPKPLLF--VAEQDGI
Bradi5g16450.1       (234)  ---------QQQQAEGTTSFENQLQQHPLSPTATTIQETT
LOC_Os04g44670.1     (230)  --------APQQREQRDTAGVSMEKKQPQPPAPTSRQEGC
Si012169m            (244)  ---------------PPPHAEGSLDKQPQPPVATSWQQDV
GRMZM2G026926_T01    (242)  ---------------PPDAERSLDKQPQPPVATSSQLEG
GRMZM2G040664_T01    (238)  ---------------PPDAEGSSDKRPQPPVATSSQLQG
Solyc07g054220.1.1   (208)  ---------LQLQTVNNEQLPPSPPPQPPP---EGDNHDE
Glyma06g45010.1      (210)  ----------NEGSTSTSSQNTKQPEPIPEEINTETEEN
Glyma12g12270.1      (212)  ----------------EEGTTNTESEDMPPTETFAVENA
Glyma12g33020.1      (214)  ----------------AKQHEPSSEHRDVPIEESNENDSG
Glyma13g37450.1      (228)  -------------ENDSGDATVSDEVHAPAATASSE----
clementine0.9_009464m (240) --------TQHAQNSLNSQVMSSEPIPAPPPQPKVEIPDS
Eucgr.K00961.1       (224)  --------TSPQASEDPTQQDSSMELMTSPP--QETNPDG
POPTR_0013s13920.1   (226)  --------QEGLNLQAETMSPPILPPQPPPEQPPGDHPDD
POPTR_0019s13330.1   (236)  -------------EGINLQVETMPPPPPPEQPQGDHPDD
AT2G20880.1          (206)  --------------------------QEPTPVHKQCETG
AT4G28140.1          (204)  -------------------EVNLESKELPVIDVGREEG-
```

FIG. 15K

| | | |
|---|---|---|
| GRMZM2G300924_T01 | (216) | SEPKPNPE--LQSADHQGDGTTAMFQPS-------GGVWG |
| GRMZM2G139765_T01 | (222) | LEHEPNSQ-LQSADHHGGDGSTVMFQPS----VASSGMWG |
| Si019997m | (218) | SEPEPNPQ-LQPADHQGGDGNAAMFKPS---VTS-SGGWG |
| Bradi3g49810.1 | (220) | PEAEQSPQLLHKAEQQCGEGSTAMAQAP---VTS-GGVWG |
| LOC_Os02g42585.1 | (232) | PEPELNPQ-LQTAEQHGSDGNTAMFQPS----VTSGGIWG |
| Bradi5g16450.1 | (234) | GSSRDAAT---------APYSAEMFHASAVASSSGGAMWA |
| LOC_Os04g44670.1 | (230) | SGGDAAAP-----------YPAEMLHAP---AAC-GGMWV |
| Si012169m | (244) | SSKTMPVS-------------GEMIHAP----VAHGSEWG |
| GRMZM2G026926_T01 | (242) | SSGEPTLA-----------DSGQMIHSP---EPPAGSDWG |
| GRMZM2G040664_T01 | (238) | GSGETTLP-----------DSDQMIHSP---EAP-GSEWG |
| Solyc07g054220.1.1 | (208) | DSGIGSSQ------------VTTNSQSS-------ELVWG |
| Glyma06g45010.1 | (210) | AET-----------------GKGISQPQ-------ELVWG |
| Glyma12g12270.1 | (212) | ----------------------------------ELVWG |
| Glyma12g33020.1 | (214) | DATVSDDQ---------VHATTESSEG-----VSQEMVWG |
| Glyma13g37450.1 | (228) | -----------------------------GVSQELVWG |
| clementine0.9_009464m | (240) | ESGLGSSEATASDDVLAAAEGSGSGEGV---SGSQELAWG |
| Eucgr.K00961.1 | (224) | DSGIGSSEATASEAVQGVAGSSIAGEGG---SVSQEMVWR |
| POPTR_0013s13920.1 | (226) | DSGMGSSGATVSDEIQAVAEGSSAGEGI---SGSQELEWG |
| POPTR_0019s13330.1 | (236) | DSGLGSSGATVSDEVQAV--GSSAGEGT---SGSQELMWG |
| AT2G20880.1 | (206) | TTSEDSSR-------RGEDDSSTALAVG---GVSEETGWA |
| AT4G28140.1 | (204) | ---------------------------------------- |

FIG. 15L

```
GRMZM2G300924_T01     (216)  PADEAWFSA----WGPGSSVW-DYDM--DNAHGLFL-QSR
GRMZM2G139765_T01     (222)  PAEEAWFSA----WGPGSSVW-DYDM--DNAHGLFL-QSR
Si019997m             (218)  PADEAWFSA----WGPGSSVW-DYDM--DNAHGLFL-QSR
Bradi3g49810.1        (220)  PADEAWFSA----WGPGSSVW-DYDM--DSAHGLFL-QSR
LOC_Os02g42585.1      (232)  PADEAWFSA----WGPGSSVW-DYDM--DSAHGLLL-QSR
Bradi5g16450.1        (234)  PPDEAWFNA----WGPGSSFW-DYDMEDDGARGLFL-HPR
LOC_Os04g44670.1      (230)  APDESWFST----WGPGSSFWDDYDM--DSARGLFL-HPR
Si012169m             (244)  PADEAWFNA----WGPGSSFW-DYDM--DSNPGLFL-HGR
GRMZM2G026926_T01     (242)  PADEAWLNA----WGPGSSFW-DYDI--DSTRGLFLHHGR
GRMZM2G040664_T01     (238)  SADEAWLNV----WGPGSSFW-DYDI--ESTRGLFHHHGR
Solyc07g054220.1.1    (208)  DMAEAWFNA--TGWGPGSPVWDDL----DTNNNLMFSPNL
Glyma06g45010.1       (210)  E----WFNAIPAGWGPGSPLP----------------HVH
Glyma12g12270.1       (212)  E----WFNAIPAGWGPGSP---------------------
Glyma12g33020.1       (214)  EMSA-WFNAIPAAWGPGSPMWDDL----DATNNLLCQSHI
Glyma13g37450.1       (228)  EMSA-WFNAIPAAWGPGSPM--------------------
clementine0.9_009464m (240)  EMAEAWFNAIPAGWGPGSPVWDDF----DSSNNLLMPANL
Eucgr.K00961.1        (224)  EMAEAWCNAMPAGWGPGSPVWDDL----DASSNILLPSHL
POPTR_0013s13920.1    (226)  DMAEAWYNAIQAGWGPGSPVWDDL----DSTNNLLLQSHL
POPTR_0019s13330.1    (236)  DMAEAWYNAIQAGWGPGSPVWDDL----DTTNNFLLQSHL
AT2G20880.1           (206)  EA---WFNAIPEEWGPGSPLWDDY-------------HFP
AT4G28140.1           (204)  -MAEAWYNAITSGWGPESPLWDDL----DSSHQFSS----
```

FIG. 15M

```
GRMZM2G300924_T01    (216) FASEATSMDYVPSTPEVPAVG------------------
GRMZM2G139765_T01    (222) FASEAASMDYVSSMPEAPATPAAG--TAVAS---------
Si019997m            (218) FASEVTSMDYVPSAPDVPVTPAAG--TAMAS---------
Bradi3g49810.1       (220) FAGEQTGMDYVPSAPEAHMAPAPG----------------
LOC_Os02g42585.1     (232) LAGEQTGMDYAYTAPEVLVAPVPAAGTAMAT---------
Bradi5g16450.1       (234) FSGDDAGVVHSGAQEIAAGTSGTP----WPCPCDDDVPVI
LOC_Os04g44670.1     (230) FTGDETSMDHSGTQATVPAVAATAAGMSMPCDDVPVT---
Si012169m            (244) FAGDEATMEHSTAQETTA----------------------
GRMZM2G026926_T01    (242) FAGDEAGINTATTAAATGTD--------MPCDHVPVTPA-
GRMZM2G040664_T01    (238) FDGDETGINTATTAAATGAG--------MSCDHVPVTPAS
Solyc07g054220.1.1   (208) HFGNFSQQEPHDSDPHQHHD--------------------
Glyma06g45010.1      (210) ISGQK-----------------------------------
Glyma12g12270.1      (212) ----------------------------------------
Glyma12g33020.1      (214) PFSNPNQQELNDAERQEQNTG-------------------
Glyma13g37450.1      (228) ----------------------------------------
clementine0.9_009464m (240) PFVNQSQQEFPDSDRQRQHDNSV----------------
Eucgr.K00961.1       (224) PFGHGNEQEFDENNVRRQQENFC-----------------
POPTR_0013s13920.1   (226) PFVNPNQQQFNDSCCVLQDNMG------------------
POPTR_0019s13330.1   (236) PFVTPNQQQFTDSSDLQRQQDNMG----------------
AT2G20880.1          (206) ISNHKDDLDATQN---------------------------
AT4G28140.1          (204) ----------------------------------------
```

FIG. 15N

| | | |
|---|---|---|
| GRMZM2G300924_T01 | (216) | TAVASLSPPPPPP----RSPTYMKEKD |
| GRMZM2G139765_T01 | (222) | AASLSSPPP-LPLP---RSPTYRW-KD |
| Si019997m | (218) | AASISLPSP-PPPP---RSPAYMW-KD |
| Bradi3g49810.1 | (220) | AASPSLPPRPPPS----HSPTFVW-KD |
| LOC_Os02g42585.1 | (232) | AASSSLPPRPPPPC---HSPTFAW-KD |
| Bradi5g16450.1 | (234) | SSSAPPPPPPPPPETAQAPSLMWKQD |
| LOC_Os04g44670.1 | (230) | SSSSDLPPQGTP-----QTPTFMWKED |
| Si012169m | (244) | AAAAGTDMSCDHVP------------- |
| GRMZM2G026926_T01 | (242) | SSSSPLHSQSPHSPSFMDH-------- |
| GRMZM2G040664_T01 | (238) | SSSSPLHSQSPPSPTFMD--------- |
| Solyc07g054220.1.1 | (208) | TNSDPSSPSCPMRPFF----------- |
| Glyma06g45010.1 | (210) | --------------------------- |
| Glyma12g12270.1 | (212) | --------------------------- |
| Glyma12g33020.1 | (214) | -----------PGYLWKDQD------ |
| Glyma13g37450.1 | (228) | --------------------------- |
| clementine0.9_009464m | (240) | SAASSTSPPCPMKPFFWKDQDHPQDSS |
| Eucgr.K00961.1 | (224) | AASSSSSSCPMKPFFWKDQD------ |
| POPTR_0013s13920.1 | (226) | SASSSSSSFFPMKSYFLKDQD------ |
| POPTR_0019s13330.1 | (236) | SASSSSSSFPTKPFFWKDQD------ |
| AT2G20880.1 | (206) | SSSDTI--------------------- |
| AT4G28140.1 | (204) | ESSSSSPLSCPMRPFF----------- |

FIG. 150

```
POPTR_0008s19390.1      (280)  ----------------------------------------
clementine0.9_032563m   (278)  ----------------------------------------
Bradi3g01901.1          (268)  ----------------------------------------
Bradi3g01910.1          (264)  ---------------------------------------M
LOC_Os02g02820.1        (276)  ---------------------------------------M
GRMZM2G139372_T02       (272)  ---------------------------------------M
Si006199m               (274)  ---------------------------------------M
Si019518m               (270)  ---------------------------------------M
Eucgr.G01783.1          (260)  ----------------------------------------
Glyma10g42830.1         (256)  ----------------------------------------
Glyma20g24170.1         (258)  ----------------------------------------
AT2G16910.1             (248)  ----------------------------------------
G1135                   (246)  MEVISCYLLLIILLLLSSNFLSSFGTISWLSLVKFSPVT
Solyc08g062780.1.1      (266)  ----------------------------------------
clementine0.9_030440m   (262)  ----------------------------------------
POPTR_0009s13860.1      (250)  ----------------------------------------
GSVIVT01013720001       (252)  ----------------------------------------
GSVIVT01024008001       (254)  -------------------------------------MFQ
```

FIG. 17A

```
POPTR_0008s19390.1     (280)  --------------------MRGLD------------RA
clementine0.9_032563m  (278)  --------------------MRDLE------------KA
Bradi3g01901.1         (268)  MGVEHQ-QHHSIVGS---SAAAAVNGHGGGGGGGGGATV
Bradi3g01910.1         (264)  GGGEHQLEHHSIVSSAAAAAAAAVHGHGGGGG------TV
LOC_Os02g02820.1       (276)  GRGDHLLMKNSN-------AAAAAAAVNGGGT------SL
GRMZM2G139372_T02      (272)  GGGVHH-------------HHPCVAADGDGAGAGPGPASV
Si006199m              (274)  GGGDHPCM-----------AATAAASAGYGGG------SV
Si019518m              (270)  GGGDHRCM-----------AATAAASAGDGGG------SV
Eucgr.G01783.1         (260)  --------------------MIIVH------------TP
Glyma10g42830.1        (256)  --------------------MNISMQ-----------HL
Glyma20g24170.1        (258)  --------------------MNIIMQ-----------NL
AT2G16910.1            (248)  --------------------MESNMQ-----------NL
G1135                  (246)  RFLRSLVFSENLVNHIERLMESNMQ------------NL
Solyc08g062780.1.1     (266)  ----------------------------------------
clementine0.9_030440m  (262)  --------------------MTVVQ------------TL
POPTR_0009s13860.1     (250)  --------------------MNVVQ------------NL
GSVIVT01013720001      (252)  --------------------MVNMVQ-----------SL
GSVIVT01024008001      (254)  NQVNRTYFDNREHSSPVTSRFFEVGMMLIAGETINMVQSL
```

FIG. 17B

| | | |
|---|---|---|
| POPTR_0008s19390.1 | (280) | MERLRPLVDSNA--WDYCVVWKLGDDPSRFIEWVGCCCGG |
| clementine0.9_032563m | (278) | VEWLRPFVDSKA--WDYCVVWKLGDDP-S----SGGVGG- |
| Bradi3g01901.1 | (268) | EAVLRPLVGADS--WDYCIYWRLSPDQ-SFLEMTGFCCS- |
| Bradi3g01910.1 | (264) | EAALRPLVGADG--WDYCIYWRLSPDQ-RFLEMTGFCCS- |
| LOC_Os02g02820.1 | (276) | DAALRPLVGSDG--WDYCIYWRLSPDQ-RFLEMTGFCCS- |
| GRMZM2G139372_T02 | (272) | EAALRPLVGVDA--WDYCVYWRLSPDQ-RFLEMAGFCCS- |
| Si006199m | (274) | EAALRPLVGADA--WDYCIYWRLSLDE-RFLEMTGLCCS- |
| Si019518m | (270) | EAALRPLVGANA--WDYCIYWRLSPDQ-RFLEMAGLCCS- |
| Eucgr.G01783.1 | (260) | MERLRPLVGSNG--WDFCVLWKLSEDQ-RLIEWIDCCCA- |
| Glyma10g42830.1 | (256) | VERLRPLVGLNG--WDYCIYWKLSEDQ-RFLEWLGCCCA- |
| Glyma20g24170.1 | (258) | VERLRPLVGLNG--WDYCIYWKLSEDQ-RFLEWLGCCCA- |
| AT2G16910.1 | (248) | LEKLRPLVGARA--WDYCVLWRLNEDQ-RFVKWMGCCCG- |
| G1135 | (246) | LEKLRPLVGARA--WDYCVLWRLNEDQ-RFVKWMGCCCG- |
| Solyc08g062780.1.1 | (266) | MERLRPIMSLKG--WDYCVLWKLSEDQ-RFLEWICCCCG- |
| clementine0.9_030440m | (262) | MDRLRPLVGLKG--WDYCVLWKLSDDQ-R---LINCCCA- |
| POPTR_0009s13860.1 | (250) | MERLRPLVGVKG--WDYCVLWKLSDDR-RYIELMDCCCA- |
| GSVIVT01013720001 | (252) | KERLRPLVGLKS--WDYCVLWKLSEDQ-RFLDWMDCCCA- |
| GSVIVT01024008001 | (254) | MERLRPLVGLKSRDWDYCVLWKLSEDQ-RFLDWMDCCCAG |

FIG. 17C

```
POPTR_0008s19390.1      (280) GGGGGYNVERDRGEDNQFGRGP--LCKDVYFKHPVRTKAC
clementine0.9_032563m   (278) GFEYVKVKE-ESGEEQKFS-----FCRDAHLKHSARTKAC
Bradi3g01901.1          (268) -------------GEFEAQVAA------------------
Bradi3g01910.1          (264) -------------GEFEA----------------------
LOC_Os02g02820.1        (276) -------------SELEAQVSA------------------
GRMZM2G139372_T02       (272) -------------SQFEAQLPA------------------
Si006199m               (274) -------------SEFEAQVSA------------------
Si019518m               (270) -------------SEFEAQVSA------------------
Eucgr.G01783.1          (260) GAE---HNE-IGNEEFDFPVS---PCRDVMFQHPRRTKAC
Glyma10g42830.1         (256) GTE---SNQ-NAGEEHLFPVSSVASCRDITYPHP-RTKPC
Glyma20g24170.1         (258) GTE---SNQ-NAGEEHIFPVSSVASCRDSTYPHP-RTKPC
AT2G16910.1             (248) GTEL--IAE-NGTEEFSYG-----GCRDVMFHHP-RTKSC
G1135                   (246) GTEL--IAE-NGTEEFSYG-----GCRDVMFHHP-RTKSC
Solyc08g062780.1.1      (266) GAEK--NMH-GCGQEIFFPDSSTSTCRDVMFQHP-TTTAC
clementine0.9_030440m   (262) GIEG--TQN-DDGDELHFPVSPFLPCRDVIFPHP-RTKSC
POPTR_0009s13860.1      (250) GTEA----T-QNGEDLQFPVSAVLPCRDVMFQHP-GTKSC
GSVIVT01013720001       (252) GSEN--STQ-NGEEEILFPVSSVLPCRDAMLQHP-RTKSC
GSVIVT01024008001       (254) GGEN--STQ-NGGEEHLFPVSSVLPCRDAMSQHP-RTKSC
```

FIG. 17D

```
POPTR_0008s19390.1      (280) EALSRFPSSMPLY-S--G----------IHGEVVISAEPR
clementine0.9_032563m   (278) EALAQLPSFMDLY-S--GKISYLNETFRIHGEVVITNQPK
Bradi3g01901.1          (268) --LGDLPSSIPLD-SSIG----------IHSQALLSNQPI
Bradi3g01910.1          (264) --LGDLPSSIPLDSSSIG----------MHAQALLSNQPI
LOC_Os02g02820.1        (276) --LLDLPSSIPLDSSSIG----------MHAQALLSNQPI
GRMZM2G139372_T02       (272) --LGDLPPSIQLDSSSAG----------MHAEAMVSNQPI
Si006199m               (274) --HGELPSSIPLDSSSAG----------MHAEAIMSNQPI
Si019518m               (270) --LGELPSSIPLDSSSAG----------MHAEAMMSNQPI
Eucgr.G01783.1          (260) ELLAQMPSSVPLE-S--G----------IYAHAFMSYQPK
Glyma10g42830.1         (256) DLLSQLSTCIPIDNS--G----------IHAQTLLTNQPN
Glyma20g24170.1         (258) DLLSQLSTSIPIDNS--G----------IHAQTLLTNQPN
AT2G16910.1             (248) EFLSHLPASIPLD-S--G----------IYAETLLTNQTG
G1135                   (246) EFLSHLPASIPLD-S--G----------IYAETLLTNQTG
Solyc08g062780.1.1      (266) NLLAQVPPSLALD-C--G----------VYAQTLLSNQAK
clementine0.9_030440m   (262) ELLSQLPSSMPLD-S--G----------IYAQSLISNQPR
POPTR_0009s13860.1      (250) ELLAQLPSSMPLN-S--G----------FHAQTLSSNLPR
GSVIVT01013720001       (252) DLLAQLPSSISLD-S--G----------IHGQTLISNQPR
GSVIVT01024008001       (254) DLLAQLPSSISLD-S--G----------IHGQTLISNQPR
```

FIG. 17E

```
POPTR_0008s19390.1      (280)  WLCHATVTTHDSNTLREVA-----G------TQVLIPVIG
clementine0.9_032563m   (278)  WISLA--NSSDSIASHQSN-----S------TRVLIPVFG
Bradi3g01901.1          (268)  WQSYS--SDVA-QTHDTAG-----GNGGGEKTRLLVPVAG
Bradi3g01910.1          (264)  WQSCS--GDMAPQVQDTAG-----G----EKTRLLVPVAG
LOC_Os02g02820.1        (276)  WQ-----SSSEEEADGGG------G----AKTRLLVPVAG
GRMZM2G139372_T02       (272)  WQSS---RVPELQTGYSSGMVQEPGSSGGPRTRLLVPVAG
Si006199m               (274)  WQTSS--CVPELPTSYSTE-----LGSAGPRTRLLVPIAG
Si019518m               (270)  WQTSC--VPELPTSYSTEL-----G-SAGPRTRLLVPIAG
Eucgr.G01783.1          (260)  WLNFA--SSSDSKAEEGTI-----G------TKVLVPFTG
Glyma10g42830.1         (256)  WVNYS--NGMDPNILEETI-----G------TQVLISVPG
Glyma20g24170.1         (258)  WVNYS--NGMDPNILEETI-----G------TQVLISVPG
AT2G16910.1             (248)  WL--S--ESSEPSFMQETI-----C------TRVLIPIPG
G1135                   (246)  WL--S--ESSEPSFMQETI-----C------TRVLIPIPG
Solyc08g062780.1.1      (266)  WMNFV--PFSESNISNEIM-----G------TRALIPSPL
clementine0.9_030440m   (262)  WLNFS--NSADLEVMEETL-----W------TRVLIPIMG
POPTR_0009s13860.1      (250)  WLNFS--SSSDSNVLEETV-----G------TRALIPVPG
GSVIVT01013720001       (252)  WLNFC--NSSDSSVLEETV-----G------TRLLIPVLG
GSVIVT01024008001       (254)  WLNFC--NSSDSSILEETV-----G------TGLLIPVLG
```

FIG. 17F

```
POPTR_0008s19390.1    (280) GLVELFAAKHMKKDEKMIESIRAHCHVPVKQEAV--TELG
clementine0.9_032563m (278) GLIELFAAKHISKDQNIIELVLAHCNTSIEQRVVP-----
Bradi3g01901.1        (268) GLVELFASRYMAEEQEMAEMVMVQCG--------------
Bradi3g01910.1        (264) GLVELFASRYMAEEQEMAELVMAQCG--------------
LOC_Os02g02820.1      (276) GLVELFASRYMAEEQQMAELVMAQCG-------GGGAGDD
GRMZM2G139372_T02     (272) GLVELFAARYMAEEEQMAELVMAQCGVP----------SG
Si006199m             (274) GLVELFAARYMAEDEQMAKLVMAQCGVPARATEGEGDEGG
Si019518m             (270) GLVELFAARYMAEEEQMAELVMAQCGVPARATEGEGDEGG
Eucgr.G01783.1        (260) GLVELFVTKQVPEDQQIIGFITSQFSIPFEA-----DSLS
Glyma10g42830.1       (256) GLVELFVTKQVSEDHQLIDFVTNQCI------EAVNHSMS
Glyma20g24170.1       (258) GLVELFVTKQVPEDHQLIDYVINQCI-------------E
AT2G16910.1           (248) GLVELFATRHVAEDQNVVDFVMGHCN--------------
G1135                 (246) GLVELFATRHVAEDQNVVDFVMGHCN--------------
Solyc08g062780.1.1    (266) GLLELFSTQQLAEDEKVIEFVSAQCNIYLEQQAMMNSTFS
clementine0.9_030440m (262) GLIELFATKEVSEEPHVIDFIIAQCNI-------------
POPTR_0009s13860.1    (250) GLMELFIAKQVPEDQHVIDVVTSQCNFLMEQEAMINST--
GSVIVT01013720001     (252) GLIELFVANQVAEDQHVVNFVTTQCNIILMEQEAM-MNSS
GSVIVT01024008001     (254) GLIELFVAKQVAEDQHVINFVTTQCHMISMEQEAM-MNSS
```

FIG. 17G

```
POPTR_0008s19390.1      (280)  YSNSSFNDHRLDSLLEENLPHSCHLLSLIPRT--------
clementine0.9_032563m   (278)  -AGSSYDVGLDEKCLDILLKENLQNFP-------------
Bradi3g01901.1          (268)  -GGHGWQLQQPATAAEDQ-------FYAATSV--------
Bradi3g01910.1          (264)  -GGHGWQLQQQQPAMAAAEEEQ---FYAATSV--------
LOC_Os02g02820.1        (276)  GGGQAWPPPETPSFQWDGGADAQRLMYGG-----------
GRMZM2G139372_T02       (272)  GEGGAWP---PGFAWDGGASDASRGMYGDAVP--------
Si006199m               (274)  AAVHTWP-EAPGFAWDGADPQR---MYGAVPP--------
Si019518m               (270)  AAVHTWP-EAPGFAWDGADPQR---MFGAVPP--------
Eucgr.G01783.1          (260)  SVCMETNFSIIPNALNDLQSRPQMIDPNDHTDSPAQLPEN
Glyma10g42830.1         (256)  FNIDVSNMQSNPLIQDENEGNNNRNNNHLFHPSEHVITDM
Glyma20g24170.1         (258)  AVNHSMSFHIDENSMSNMQSNP---LIGDENEGNNNSRDT
AT2G16910.1             (248)  -MLMDDSVTINMMVADEVESKPYGMLSGDIQQKGSKEEDM
G1135                   (246)  -MLMDDSVTINMMVADEVESKPYGMLSGDIQQKGSKEEDM
Solyc08g062780.1.1      (266)  NGVEENNTSKPFPT--EGERDRDDHIKDSQNHYKQRVSPA
clementine0.9_030440m   (262)  -SMEQDPMNMNTSCYLDNASSSVNVHAMALEN--------
POPTR_0009s13860.1      (250)  -NMDSSLSNIDVNVMSENQSKP---FLANENE-----QED
GSVIVT01013720001       (252)  NIDTIFSVNANAGNADE-EKDPNNHFQATISP----VTAL
GSVIVT01024008001       (254)  NINSIFSVNVNGGNADENQKDPNNHFQAPISP----VTAM
```

FIG. 17H

```
POPTR_0008s19390.1    (280)  ------------------------QFLLPLSQPR-----
clementine0.9_032563m (278)  ------------------------SPLQLLTFVPGTQV-
Bradi3g01901.1        (268)  ------------------------ASLNLFDSGG-----
Bradi3g01910.1        (264)  ------------------------ASLNLFDGGGGGAG-
LOC_Os02g02820.1      (276)  ------------------------SSLNLFDAAAA----
GRMZM2G139372_T02     (272)  ------------------------PSLSLFDAAGSV---
Si006199m             (274)  ------------------------SLSLFDAAG------
Si019518m             (270)  ------------------------SLSLFDAAG------
Eucgr.G01783.1        (260)  LNLHDASS----------------DRIHQYEATIGGSY-
Glyma10g42830.1       (256)  DHRNIGLCNSQL-------------NFMQQFNYNQHNRMK
Glyma20g24170.1       (258)  ------------------------STLQNMSSQWTSAVL
AT2G16910.1           (248)  MNLPS-SYDISADQIRL--------NFLPQMSDYETQHL-
G1135                 (246)  MNLPS-SYDISADQIRL--------NFLPQMSDYETQHL-
Solyc08g062780.1.1    (266)  ATSDHLSFDFPLKRKQLDSCSM---NFLPPFSTYSTPEVD
clementine0.9_030440m (262)  ---SDVPYELSVDRIRICSGCTSPVNFLQQFGYSSSSKNV
POPTR_0009s13860.1    (250)  HHSLNIPYDTSLDRLHMSSSPMN--NFMHQFNYSTDETK-
GSVIVT01013720001     (252)  ENLNDLPFDISVERIRLCSSPM---NFLQQFSYTSESSV-
GSVIVT01024008001     (254)  EDLNDLP--ISVDQIRLCSSPM---NFLQQFSYTSESSI-
```

FIG. 17I

```
POPTR_0008s19390.1      (280)  -----------NSISFEGSSSGSNPSNEAPSFVSNASQLP
clementine0.9_032563m   (278)  ----LSAATQFNTHPYNEGSSRGSNPSIEHPSFDSNYGYI
Bradi3g01901.1          (268)  -----------GEDQFLA-----PAAEAGEDGGAASWGFA
Bradi3g01910.1          (264)  -----------GDDQFLA------AGAGEDDGGAAAWGVA
LOC_Os02g02820.1        (276)  ----------DDDPFLGGGGGDAVGDEAAAAGAWPYAGM
GRMZM2G139372_T02       (272)  -----------AADPFQA-VQQAPGAGGGGVDDVAGWQYA
Si006199m               (274)  -------------DPFLA----APPPGVVDDAAAAGWQYA
Si019518m               (270)  -------------DPFLV----APPPGVVDDAAAAGWQYV
Eucgr.G01783.1          (260)  --------DTFVANEEMNPSNKLSAMDGFQEMDGAEQMNVD
Glyma10g42830.1         (256)  SDAAFSEEYQ-AGNSFLHDEQTNPEDDQEPGHEHDTYQKS
Glyma20g24170.1         (258)  -----------VSGSFLH-DKQTNQEDQEHEHEHDTYQKS
AT2G16910.1             (248)  ---KMKSDYHHQALGYLPENGNKEMMGMNPFNTVEEDGIP
G1135                   (246)  ---KMKSDYHHQALGYLPENGNKEMMGMNPFNTVEEDGIP
Solyc08g062780.1.1      (266)  NNTGGNMLFDQSTSDMTH------FSENRYMSEMDAYLQK
clementine0.9_030440m   (262)  KRHRNDVFFEGSRDDSTHQNGIQEMDNASNMNM--QFMEP
POPTR_0009s13860.1      (250)  ---TKGDLFQGVESGLQDMDDLQKSMMANAESTQMQYMES
GSVIVT01013720001       (252)  -----------KNDIFFE-----------------GSDGS
GSVIVT01024008001       (254)  ----------------------------------------
```

FIG. 17J

```
POPTR_0008s19390.1      (280)  QHGHLELSVGKSNHDE------------KILKQRAGSADC
clementine0.9_032563m   (278)  AQNAPLMQ--------------------PIGNSFAKRPKC
Bradi3g01901.1          (268)  AGNSEPSAAVHEQLYSG-----------GVAARAESGSEG
Bradi3g01910.1          (264)  AGTSSEAAHEQQQLYSGGA---------AAAARAESGSEG
LOC_Os02g02820.1        (276)  AVSEPSVAVAQEQMQHA-----------AGGGVAESGSEG
GRMZM2G139372_T02       (272)  AAAGSELEAVQLQQE-------------QQPRDADSGSEV
Si006199m               (274)  AAAGSEPSVVAAQQEQHGA---------ARTGGADSGSEG
Si019518m               (270)  AAVAAQQEQHGA----------------ARAGGADSGSEG
Eucgr.G01783.1          (260)  LTEQVNTEWQGNDEETVK----------PENGATKSTSDC
Glyma10g42830.1         (256)  LMTTDSQYVEAKDQKQEE----DKDLMKNVVGRSDSMSDC
Glyma20g24170.1         (258)  LMTTTDSQYEDKDLLK------------NVVGRSDSMSDC
AT2G16910.1             (248)  VIGEPSLLVNEQQVVNDK----DM----NENGRVDSGSDC
G1135                   (246)  VIGEPSLLVNEQQVVNDK----DM----NENGRVDSGSDC
Solyc08g062780.1.1      (266)  QMMRSSSTQAGIDDESIK----------HDNGRSNSGSD-
clementine0.9_030440m   (262)  NMGNKELQQGNYDDLNKDLIKPDQNNNNNNNGRSDSISDC
POPTR_0009s13860.1      (250)  GLTTKDQHGNDKESIKLE----------NGPSAEYSHSDC
GSVIVT01013720001       (252)  FLSEKEQLGDDKDSSTK-----------QMANQADSVSDC
GSVIVT01024008001       (254)  ---KNDQLGDDHKDLSAK----------RTANQADSVSDC
```

FIG. 17K

```
POPTR_0008s19390.1    (280) NKKV-------PKVM-RRSERD--------DYKS KNLVTER
clementine0.9_032563m (278) KSHV---FKEELGER-HRLGRA------------ KNLITER
Bradi3g01901.1        (268) SELQ-GDDDVDGEVQ--RGGKDGGTGGGKRQQC  KNLMAER
Bradi3g01910.1        (264) SELQGDDDDVDGGVQRKDGGHG--GGGGKRQQC  KNLMAER
LOC_Os02g02820.1      (276) RKLHGGDPEDDGDGEGRSGGAK-------RQQC  KNLEAER
GRMZM2G139372_T02     (272) SDMQ-GDPEDDGDGD--AQGRGGGKGGGKRQQC  KNLEAER
Si006199m             (274) SDLL-GDPEGDGDAQGRGGGKG----DGKRQHC  KNLVAER
Si019518m             (270) SDLQ-GDPEDDGDDDVQGRGGGGGKGGGKRQQC  KNLVAER
Eucgr.G01783.1        (260) SDQN--EEDDE------RNGKQ--------PHS  KNLQAER
Glyma10g42830.1       (256) SDQN-EEEELDGKYR-RRNGKG--------NQS  KNLVAER
Glyma20g24170.1       (258) SDQN--EEEDGKYR-RRNGKG--------NQS   KNLVAER
AT2G16910.1           (248) SDQI--DDEDDPKYK-KKSGKG--------SQA  KNLMAER
G1135                 (246) SDQI--DDEDDPKYK-KKSGKG--------SQA  KNLMAER
Solyc08g062780.1.1    (266) SDQN--EEEDPKYR-RRNGKG--------PQS   KNLMAER
clementine0.9_030440m (262) SDQI-DDLEDDVKYRPRRNGKE--------PQS  KNLVAER
POPTR_0009s13860.1    (250) N-----DDEDDAKYR-RRTGKG--------PQS  KNLVAER
GSVIVT01013720001     (252) SDQI--DDDDLKYR-RRTGKG--------TQS   KNLVAER
GSVIVT01024008001     (254) SDQI--DDDDLKFQ-RRTGKG--------AQS   KNIDAER
Consensus             (518)                                     KNXXXER
```

FIG. 17L

| | | |
|---|---|---|
| POPTR_0008s19390.1 | (280) | NRRTRIKTGLFALRALVPKISKMDKAAILGDAIDYVGELL |
| clementine0.9_032563m | (278) | NRRNKLKDGLFALRALVPKISKMDRAAILGDAAEYIKELL |
| Bradi3g01901.1 | (268) | NRRKKLNDRLYKLRSLVPNITKMDRAAILGDAIDYIVGLQ |
| Bradi3g01910.1 | (264) | KRRKKLNDRLYKLRSLVPNITKMDRASILGDAIDYIVGLQ |
| LOC_Os02g02820.1 | (276) | KRRKKLNGHLYKLRSLVPNITKMDRASILGDAIDYIVGLQ |
| GRMZM2G139372_T02 | (272) | KRRKKLNERLYKLRSLVPNISKMDRAAILGDAIDYIVGLQ |
| Si006199m | (274) | KRRQKLNNALYKLRSLVPKITKMDRASILGDAIDYIVGLQ |
| Si019518m | (270) | KRRKKLNERLYKLRSLVPNITKMDRASILGDAIDYIVGLQ |
| Eucgr.G01783.1 | (260) | RRRKKLNDRLYNLRSLVPKISKLDRASILGDAIEYIMELQ |
| Glyma10g42830.1 | (256) | KRRKKLNDRLYNLRSLVPRISKLDRASILGDAIEYVKDLQ |
| Glyma20g24170.1 | (258) | KRRKKLNDRLYNLRSLVPRISKLDRASILGDAIEYVKDLQ |
| AT2G16910.1 | (248) | RRRKKLNDRLYALRSLVPRITKLDRASILGDAINYVKELQ |
| G1135 | (246) | RRRKKLNDRLYALRSLVPRITKLDRASILGDAINYVKELQ |
| Solyc08g062780.1.1 | (266) | KRRKKLNERLYALRALVPKISKLDRASILGDAIEYVMELE |
| clementine0.9_030440m | (262) | KRRKKLNDRLYALRALVPIITKLDRATILVDAIEYVKQLQ |
| POPTR_0009s13860.1 | (250) | KRRKKLNDRLYALRSLVPNISKLDRASILGDAIEFVKELQ |
| GSVIVT01013720001 | (252) | RRRKKLNDRLYALRALVPKISKLDRASILGDAIEFVKELQ |
| GSVIVT01024008001 | (254) | RRRKKLNDRLYALRSLVPKISKLDRASILGDAIEFVKELQ |
| Consensus | (518) | XRRXXXXXLXXLRXLVPXIXKXDXAXILXDAXXXXXXLX |

FIG. 17M

```
POPTR_0008s19390.1      (280) KEVKNLQDEIKNAEEEE------------------RRAS
clementine0.9_032563m   (278) QEVDKLQDELKENEDCE----------------KDNEEMK
Bradi3g01901.1          (268) KQVKELQDELEEEENPNPNNGI--MAPDVLTMDDHPPPG-
Bradi3g01910.1          (264) KQVKDLQDELEEEDNPN--------NPDVLTMDDHPPPG-
LOC_Os02g02820.1        (276) KQVKELQDELEDNHVHH-------KPPDVLI--DHPPPAS
GRMZM2G139372_T02       (272) NQVKALQDELEDPADGA-------GAPDVLL--DHPPPAS
Si006199m               (274) NQVKALQDELEDPADGA---------PDVLL--DHPPPAS
Si019518m               (270) NQVKALQDELEDPADGA---------PDVLL--DHPPPAS
Eucgr.G01783.1          (260) KQAKELQDELEEQSDVE--------DPRNSGSSSNFTVGQ
Glyma10g42830.1         (256) KQVKELQDELEENADTESNCMNIGVGAELGPNAEHDKAQT
Glyma20g24170.1         (258) KQVKELQDELEENADTESNCMN--CVSELGPNAEHDKAQT
AT2G16910.1             (248) NEAKELQDELEENSETE-------------DGSNRPQGG
G1135                   (246) NEAKELQDELEENSETE-------------DGSNRPQGG
Solyc08g062780.1.1      (266) KQVKDLQLEVEEHSDDD--------GTGGGRNSDQIHPVV
clementine0.9_030440m   (262) KQEKELKEELEENSDDD--GAA--KNDDMGISVNNHNAVK
POPTR_0009s13860.1      (250) KEAKELQDELEENSEDE--------GAKNG-NNNNMPPEI
GSVIVT01013720001       (252) KQAKDLQDELEEHSDDE----G--GKINAGINSNHNNVQS
GSVIVT01024008001       (254) KQAKDLQDELEENSEDE---------VNIGPKTENEETQN
Consensus               (518) XXXX
```

FIG. 17N

```
POPTR_0008s19390.1      (280)  NIELKTSKLEI-------------FQEDHVSSSKIN----
clementine0.9_032563m   (278)  SFKLDE------------------IHEGTSTTYLPA--SE
Bradi3g01901.1          (268)  ---LDNDDVSPPPPQPPLC-----KKRARAAAAAAGEDQ
Bradi3g01910.1          (264)  ---LDNDEASPPPP----------QKRARAPAADPE--EE
LOC_Os02g02820.1        (276)  LVGLDNDDASPPNSHQQQPPLAVSGSSSRRSNKDPA--MT
GRMZM2G139372_T02       (272)  LVGLENDESPPTSHQHPLAG----TKRARAA---------
Si006199m               (274)  LVGLENDDSPRASLQQPPA-----SKRARVPAAAPT----
Si019518m               (270)  LVGLENDDSPRA------------SKRARVAAAAPA----
Eucgr.G01783.1          (260)  PEFFDIGFLSASEKVAFTY-----QLPGNTQGDGST--RR
Glyma10g42830.1         (256)  GLHVGTSG---------NG-----YVSKQKQE--------
Glyma20g24170.1         (258)  GLHVGTSG---------NG-----YVSKQKQEAKFIKLRE
AT2G16910.1             (248)  MSLNGTVV---------TG-----FHPGLSCNSNVPSVKQ
G1135                   (246)  MSLNGTVV---------TG-----FHPGLSCNSNVPSVKQ
Solyc08g062780.1.1      (266)  LSHNGTKNRPKSDNGKLTNG----SQREISTNSNGSTDPS
clementine0.9_030440m   (262)  SESLTQNGTNFGPK----------TEPKQCHMGNGR--KQ
POPTR_0009s13860.1      (250)  LNQNGVNLGAYRSDYAVNG-----FHVEASGISTVS--KQ
GSVIVT01013720001       (252)  E-ILNNDG---------SG-----VNIGL-----PK--QN
GSVIVT01024008001       (254)  RFLMGAAG---------NG-----IAASACRPPSAK--QN
```

FIG. 17O

```
POPTR_0008s19390.1    (280)  ---QDSSGFVEKKGAEVQLEVDQI-SKRQ-FLLKFLCEQR
clementine0.9_032563m (278)  HNKSFPACGEKGKS-EVRVEVNQI-NDRD-FLIKLLCEHE
Bradi3g01901.1        (268)  EEKDDDKGGDQDQDMEPQVEVRQV-DGSDEFFLQVLCSHK
Bradi3g01910.1        (264)  EE--KGEQEEQEQDMEPQVEVRQVGGGGEEFFLQVLCSHK
LOC_Os02g02820.1      (276)  DD-KVGGGGGGGHRMEPQLEVRQV-QGNE-LFVQVLWEHK
GRMZM2G139372_T02     (272)  ---AEEEEEEKGNDMEPQVEVRQV-EANE-FFLQMLCERR
Si006199m             (274)  -------EEDKGHDMEPQVEVRQV-EANE-FFLQVLCEHK
Si019518m             (270)  -------EEEKGHDMEPQVEVRQV-EANE-FFLQVLCEHK
Eucgr.G01783.1        (260)  NR-ESETAYDKQQRMEPQVEVRQM-DENE-FFIKVFGEHR
Glyma10g42830.1       (256)  ---DMHECANLLIEMQPQVEVALI-DENE-YFVKVFCEHR
Glyma20g24170.1       (258)  RINKIRYIANLLNEMQPQVEVALI-DGNE-YFVKVFCEHR
AT2G16910.1           (248)  DV-DLENSNDKGQEMEPQVDVAQL-DGRE-FFVKVICEYK
G1135                 (246)  DV-DLENSNDKGQEMEPQVDVAQL-DGRE-FFVKVICEYK
Solyc08g062780.1.1    (266)  RKNQDVEENDKLQQMEPQVEVAQL-DGNE-FFVKVFREHK
clementine0.9_030440m (262)  DQ-DSENTIDKGQQMEVQVEVAQL-NGNE-FFIKVFCEHK
POPTR_0009s13860.1    (250)  NQ-DSENSHDKGHQMEAQVEVAQI-DGNE-FFVKVFCEHK
GSVIVT01013720001     (252)  HE-TDQINNDKAQQMEPQVEVAQI-EGNE-FFVKVFCEHK
GSVIVT01024008001     (254)  HE-TDQITDDKAQQMEPQVEVAQI-EGND-FFVKVFCEHK
```

FIG. 17P

```
POPTR_0008s19390.1      (280)  QGGFGRLMETIHSLGLQILDANITTFNGNVLNILKVEADK
clementine0.9_032563m   (278)  RGGFVRLMEAINSLELQVIDANVTTFNGKVLNILRVQAHK
Bradi3g01901.1          (268)  SGRFVRIMDEIAALGLQVTNVNVTSYNKLVLNVFRAV-MR
Bradi3g01910.1          (264)  PGRFVRIMDEIAALGLQVTNVNVTSYNKLVLNVFRAV-MR
LOC_Os02g02820.1        (276)  PGGFVRLMDAMNALGLEVINVNVTTYKTLVLNVFRVM-VR
GRMZM2G139372_T02       (272)  PGRFVQIMDSIADLGLEVTNVNVTSHESLVLNVFRAA-RR
Si006199m               (274)  PGRFVRLMDAVNALGLDVTNVNVTSYKTLVLNVLRVV-RR
Si019518m               (270)  PGRFVRLMDAVNALGLDVTNVNVTSYKTLVLNVLNVA-RR
Eucgr.G01783.1          (260)  PGGFVRLMEALDSIGLEVTNANVTRFLSLVSNVFTVE-KK
Glyma10g42830.1         (256)  PGGFVKLMEALNTIGMDVVHATVTSHTGLVSNVFKVE-KK
Glyma20g24170.1         (258)  PDGFVKLMEALNTIGMDVVHATVTSHTGLVSNVFKVE-KK
AT2G16910.1             (248)  PGGFTRLMEALDSLGLEVTNANTTRYLSLVSNVFKVE-KN
G1135                   (246)  PGGFTRLMEALDSLGLEVTNANTTRYLSLVSNVFKVE-KN
Solyc08g062780.1.1      (266)  AGGFVRTLEALNSLGLEVTNVNATRHTCLVSSIFKVEQKR
clementine0.9_030440m   (262)  PGGFVRLMEALNSLGLEVTNANVTSRTGLVSNVFNVK-KR
POPTR_0009s13860.1      (250)  PGGFVRLMEALDSLGLEVTNANVTSNRGLVSNVLKVE--K
GSVIVT01013720001       (252)  AGGFARLMEALSSLGLEVTNANVTSCKGLVSNVFKVE-KR
GSVIVT01024008001       (254)  AGGFVRLMEALSSLGLEVTNANVTSCKGLVSNLFKVE-KR
```

FIG. 17Q

```
POPTR_0008s19390.1    (280)  D----IHPKTLKKSLIELTGNLIQT---------------
clementine0.9_032563m (278)  EN---IRLKKLRETLIELT-----G---------------
Bradi3g01901.1        (268)  ENEAAVPVDRVRDSLLEATREMYGAGGCVWPVAAMAPPPL
Bradi3g01910.1        (264)  ENEAAVPADRVRDSLLEVTREMYGA-GGVWP-----AAMA
LOC_Os02g02820.1      (276)  DSEVAVQADRVRDSLLEVTRETYPG---VWP--S------
GRMZM2G139372_T02     (272)  DNEVAVQADRLRDSLLEVMREPYGV----WS--SSAPPVG
Si006199m             (274)  DNEVAVQADRVRDSLLEVTRESYGV----WS-------SA
Si019518m             (270)  DNEVAVQADRVRDSLLEVTRESYGV----WS----AAAPA
Eucgr.G01783.1        (260)  DSEL-VEADLLKDSLLELTRNPTSG----WP---------
Glyma10g42830.1       (256)  DNET-VEAEDVRDSLLELTRNRYG-----WT---------
Glyma20g24170.1       (258)  DSET-VEAEDVRDSLLELMRNRYG-----WT---------
AT2G16910.1           (248)  DNEM-VQAEHVRNSLLEITRNTSRG----WQ-------DD
G1135                 (246)  DNEM-VQAEHVRNSLLEITRNTSRG----WQ-------DD
Solyc08g062780.1.1    (266)  DNEM-VQADHVRDTLLELTRNPSRG----WS---------
clementine0.9_030440m (262)  DNEM-VQADHVRDSLLELTRNPARE----WI---------
POPTR_0009s13860.1    (250)  DSEM-VQADYVRDSLLELTRDPPRA----WP---------
GSVIVT01013720001     (252)  DSEM-VQADHVRDSLLELTKSPSEK----WS---------
GSVIVT01024008001     (254)  DSEM-VQADHVRDSLLELTKNPSEK----WH---------
```

FIG. 17R

```
POPTR_0008s19390.1     (280)  ------------------------------------------
clementine0.9_032563m  (278)  ------------------------------------------
Bradi3g01901.1         (268)  TTRETPTTTMMMAEVAKLYGGQA-----------GEHHYH
Bradi3g01910.1         (264)  PLPAMEAPMMVMAAEAKLDGGGEA----------GEHHYQ
LOC_Os02g02820.1       (276)  ---------PQEEDDAKFDGGDGGQA-AAAAAAAGGEHYH
GRMZM2G139372_T02      (272)  MSGSGIADVKHDSVDMKLDGIIDGQAAPSVAVGVSEDHY-
Si006199m              (274)  VGSSGSIDVKLNCVDVKLDGGVDVQA--PAAAATAEDHY-
Si019518m              (270)  AGSSGSIDVKLDCVDVKLDGGVDVQA----PAAAAEDHY-
Eucgr.G01783.1         (260)  ----------GLSKAVETGSARNYHG--------HQHHYH
Glyma10g42830.1        (256)  -----------HEMTATPENGVGRDQ--------HQLHNH
Glyma20g24170.1        (258)  -----------HEMTATSGNSVESDQ--------HQLHNH
AT2G16910.1            (248)  QMATGSMQNEKNEVDYQHYDDHQHH---------NGHHHP
G1135                  (246)  QMATGSMQNEKNEVDYQHYDDHQHH---------NGHHHP
Solyc08g062780.1.1     (266)  ---EMGRASSDNINNNNANGTTDYHQ--------HQLHDH
clementine0.9_030440m  (262)  -------ENVAKASDSTVNNGINYHH--------HEQLH
POPTR_0009s13860.1     (250)  ---EMPKASEICC------SGMDYPH--------HDHHQH
GSVIVT01013720001      (252)  ---------DQMAYPLENGGGLDF----------HHHHYH
GSVIVT01024008001      (254)  ---------GQMAYASENGGGLDFHN--------HHHHHH
```

FIG. 17S

```
POPTR_0008s19390.1      (280)  --------FGSQI-----------
clementine0.9_032563m   (278)  ------------------------
Bradi3g01901.1          (268)  LQQQQHQELGGYH-QHHLHYLGLD
Bradi3g01910.1          (264)  LQQQQL--LGGYHQQQHLYYLGLD
LOC_Os02g02820.1        (276)  DEV-----GGGYH--QHLHYLAFD
GRMZM2G139372_T02       (272)  ---------GGYN--HLLQYLA--
Si006199m               (274)  ---------GGY---NHLQYLA--
Si019518m               (270)  ---------GGYN--HLLQYLT--
Eucgr.G01783.1          (260)  LLH------------NHLF-----
Glyma10g42830.1         (256)  QQ-------IGAYP--HQFHS----
Glyma20g24170.1         (258)  NQ-------MGAYP--HEFHS----
AT2G16910.1             (248)  FDHQMNQSAHHHHHHQHINHYHNQ
G1135                   (246)  FDHQMNQSAHHHHHHQHINHYHNQ
Solyc08g062780.1.1      (266)  HLDNNNQHKQTNS--HHFHTHHHH
clementine0.9_030440m   (262)  SHH-----MSTHH--HHLHHN---
POPTR_0009s13860.1      (250)  HLQNGH--MNYNH--HHLHHL---
GSVIVT01013720001       (252)  LHSHLLSS-------HHLHHHQN-
GSVIVT01024008001       (254)  LHSHLLSS-------HHLHHLQN-
```

FIG. 17T

```
Glyma20g02160.1      (304) ---------SKLTFNMSD-SF--GSTFHSSTPNS-----T
AT3G18010.1          (282) --MWTMGYNEGG----AD-SFNGGRKLRPLIPRL------
POPTR_0010s12150.1   (310) --MWMINGGDSNEPSMND--F--------FNPKP------
GSVIVT01011738001    (302) --MWTMDSSDSSDLTMSD-SF-HGRKLRPLVPRPNASVLP
Solyc03g118770.2.1   (292) --MWMMGYNEGGDFNMSDSC--NGRKLRPLMPRV--P---
Eucgr.B00945.1       (284) -----MGCHDDGDLYMAE-SF-NGRKLRPLMPRP--VTNP
Glyma07g11370.1      (294) --MWMMGY-EGGEFNMVEHSLITGRKLKPLMPRP--M--T
Glyma09g30830.1      (298) ----------------------------------------
Glyma05g33850.1      (288) --MWMVGYNEGGEFNMADYGF-NGRKLRPLMPRP-----V
Glyma08g05830.1      (286) --MWMVGYNEGAEFNMADYGF-NGRKLRPLMPRP-----V
GSVIVT01008424001    (290) --MWMMGYNDGGELNMPD-SF-NGRKLRPLIPRP-----A
POPTR_0012s04510.1   (296) --MWMMGYNDSGDFDMPD-SF-NDRKLKTLVPRP--L--P
POPTR_0015s04520.1   (300) --MWMMGYNDGGEFNISD-SF-NGRKLRPLVPRP--I--P
LOC_Os01g62310.1     (316) METTTTLGGGGGGRAGGFSDPPSPLSPPLSPA-------
GRMZM2G108933_T01    (322) --METPQQQSAAAAAAAAHGQ-DDGGSPPMSPA-------
Si004427m            (318) -MEAAPQHGGAGVIDLEGSGSGGAPLSPPLSPA-------
AT5G59340.1          (306) MENEVNA---------------------------------
POPTR_0001s24470.1   (328) -----MDVSSSG----------------------------
POPTR_0009s03460.1   (326) MDSDDMDVAGSG----------------------------
Eucgr.B02379.1       (314) -----MGGSGGG----------------------------
Solyc06g076000.1.1   (312) MSDSSVDMITSG----------------------------
Glyma11g14940.1      (308) -------MESGGS---------------------------
Glyma13g41000.1      (320) MESHSSDAEAEN----------------------------
Glyma15g04460.1      (324) MESHSTAEDESGWK--------------------------
```

FIG. 19A

```
Glyma20g02160.1       (304)  LNSHAPPKITTFCSIAQPYCICTHCNHILTFNHHV-----
AT3G18010.1           (282)  ----------TSCPTAA-----VNTNSDHRFNMAV-----
POPTR_0010s12150.1    (310)  -------NTTTLCTYTT-----ATPLTYVGLKHHL-----
GSVIVT01011738001     (302)  KITVNSTVAISPCI-SH-----LHGTDLFALNHHL-----
Solyc03g118770.2.1    (292)  ---HAPTANPTNCL-RN-----FHGENFIALNHHQ-----
Eucgr.B00945.1        (284)  SPNNGGTNAAPPCL-SR-----IHGADILALNHHL-----
Glyma07g11370.1       (294)  TSLNNAPTTTTPSL-SQ-----IHGNDFLSQYHYH-----
Glyma09g30830.1       (298)  ----------------------------------------
Glyma05g33850.1       (288)  TSPNNTSNTNSPCLSRI-----HHGNNFFSQYHNL-----
Glyma08g05830.1       (286)  TSPNNTSNTNSPYLTRI-----HHGNDFFSQYHNL-----
GSVIVT01008424001     (290)  TSTSGTATTTSSCLSR------IHGTDLFGLNHHL-----
POPTR_0012s04510.1    (296)  STNNTSTASGHPCPGSR-----LHSTDFLALNQYHLGLGM
POPTR_0015s04520.1    (300)  STNNTPTASSPPCLGSR-----LHNTDFFALNQYH--LGM
LOC_Os01g62310.1      (316)  ----------------------------------------
GRMZM2G108933_T01     (322)  ----------------------------------------
Si004427m             (318)  ----------------------------------------
AT5G59340.1           (306)  ----------------------------------------
POPTR_0001s24470.1    (328)  ----------------------------------------
POPTR_0009s03460.1    (326)  ----------------------------------------
Eucgr.B02379.1        (314)  ----------------------------------------
Solyc06g076000.1.1    (312)  ----------------------------------------
Glyma11g14940.1       (308)  ----------------------------------------
Glyma13g41000.1       (320)  ----------------------------------------
Glyma15g04460.1       (324)  ----------------------------------------
```

FIG. 19B

```
Glyma20g02160.1        (304) --------------------------G-NSQQQQSTRWS
AT3G18010.1            (282) ---------VTMTAEQNKRELMMLNSEPQHPPVMVSSRWN
POPTR_0010s12150.1     (310) ---------AKTSEQSRGRKL------KEQAEATRSSRWN
GSVIVT01011738001      (302) ---------GGTSDQQRKTDF------N-TQPF-GSSRWN
Solyc03g118770.2.1     (292) ----------LAMSEQNKRDF------N--TQLVVSSRWN
Eucgr.B00945.1         (284) -----------ATMAEQKREF------N-SPQVVVSSRWN
Glyma07g11370.1        (294) -------------HLEQNKREF------NGAAPVVVSSRWN
Glyma09g30830.1        (298) -------------AEKNKREF------NGATPVVVSSRWN
Glyma05g33850.1        (288) -----------VADQGKREF------N-PPPVVVSSRWN
Glyma08g05830.1        (286) ----------ASVADQGKREF------N-PPPVVVSSRWN
GSVIVT01008424001      (290) -------------EQSNIREF------N-TTPVIVSSRWN
POPTR_0012s04510.1     (296) HLSFLLSLSLI-------REF------N-TQPVVMSSRWN
POPTR_0015s04520.1     (300) HLSFLFSLSLSSMADQNKREF------N-TQPVVMSSRWN
LOC_Os01g62310.1       (316) --------------------------SAAAAALANARWT
GRMZM2G108933_T01      (322) --------------------------SAAAAALANARWN
Si004427m              (318) --------------------------SAAAAALANARWN
AT5G59340.1            (306) ----------------------------GTASSSRWN
POPTR_0001s24470.1     (328) ----------------------------GASVNSRWS
POPTR_0009s03460.1     (326) ----------------------------GAPGNSRWN
Eucgr.B02379.1         (314) ----------------------------SPATSRWN
Solyc06g076000.1.1     (312) ----------------------------GSPVGCRWN
Glyma11g14940.1        (308) --------------------------NGNEGVAASSRWN
Glyma13g41000.1        (320) ---------------------------VRTHSSVSRWS
Glyma15g04460.1        (324) --------------------------GSSGAHSSVSRWS
Consensus              (519)                            XXXRWX
```

FIG. 19C

| | | |
|---|---|---|
| Glyma20g02160.1 | (304) | PTPVQLLVLEELYRQGTKTPSAEQIQQIASQLRQFGKIEG |
| AT3G18010.1 | (282) | PTPDQLRVLEELYRQGTRTPSADHIQQITAQLRRYGKIEG |
| POPTR_0010s12150.1 | (310) | PTAEQLLALEEKYSCGVRTPTTNQIQQITSELRRFGKIEG |
| GSVIVT01011738001 | (302) | PTPEQLQALEELYRRGTRTPTAEQIQQIAAQLRLFGKIEG |
| Solyc03g118770.2.1 | (292) | PTPEQLQTLEELYRRGTRTPSAEQIQHITAQLRRYGKIEG |
| Eucgr.B00945.1 | (284) | PTPEQLRTLEELYRRGTRTPNADQIQQITAQLRRYGKIEG |
| Glyma07g11370.1 | (294) | PTPEQLRALEELYRRGTRTPSAEQIQHITAQLRRFGNIEG |
| Glyma09g30830.1 | (298) | PSPEQLRALEELYRRGTRTPSAEQIQHITAQLRRFGNIEG |
| Glyma05g33850.1 | (288) | PTPEQLRALEELYRRGTRTPSAEQIQQITAQLRRFGKIEG |
| Glyma08g05830.1 | (286) | PTPEQLRALEELYRRGTRTPSAEQIQQITAQLRRFGKIEG |
| GSVIVT01008424001 | (290) | PTPEQLRTLEELYRRGTRTPSAEQIQHITAQLRRYGKIEG |
| POPTR_0012s04510.1 | (296) | PTPEQLRTLEELYRRGTRTPSTDQIQDITAQLRRYGRIEG |
| POPTR_0015s04520.1 | (300) | PTPEQLRTLEDLYRRGTRTPSTDQIQDITAQLRRYGRIEG |
| LOC_Os01g62310.1 | (316) | PTKEQIAVLEGLYRQGLRTPTAEQIQQITARLREHGHIEG |
| GRMZM2G108933_T01 | (322) | PTKEQVAVLEGLYEHGLRTPSAEQIQQITGRLREHGAIEG |
| Si004427m | (318) | PTKEQLAALEGLYEHGLRTPSAEQIKQITARLREHGHIEG |
| AT5G59340.1 | (306) | PTKDQITLLENLYKEGIRTPSADQIQQITGRLRAYGHIEG |
| POPTR_0001s24470.1 | (328) | PTKEQISMLESFYSQGIRTPSTEMIEQIASRLKAYGHIEG |
| POPTR_0009s03460.1 | (326) | PTKEQISMLESFYSQGIRTPSTEMIEQITSRLKAYGHIEG |
| Eucgr.B02379.1 | (314) | PTKEQIGILESLYRQGIRTPTADQIQQITGRLKAYGHIEG |
| Solyc06g076000.1.1 | (312) | PTKEQIDLLESLYKQGIRTPSADQIQQITGRLRAFGHIEG |
| Glyma11g14940.1 | (308) | PTKEQISMLENLYKQGIKTPSAEEIQQITARLRAYGHIEG |
| Glyma13g41000.1 | (320) | PTKEQIDMLENLYKQGIRTPSTEQIQQITSRLRAYGHIEG |
| Glyma15g04460.1 | (324) | PTKEQIDMLENFYKQGIRTPSTEQIQQITSRLRAYGYIEG |
| Consensus | (519) | PXXXQXXXLEXXYXXGXXTPXXXXIXXIXXXLXXXGXIEG |

FIG. 19D

| | | |
|---|---|---|
| Glyma20g02160.1 | (304) | KNVFYWFQNHKARERQK--RRLKETGC-------------- |
| AT3G18010.1 | (282) | KNVFYWFQNHKARERQKRRRQMETGHE----------ETV |
| POPTR_0010s12150.1 | (310) | KNVFYWFQNHKARERQKHRQVQQKHNN------------- |
| GSVIVT01011738001 | (302) | KNVFYWFQNHKARERQKRRRELESDSE------------E |
| Solyc03g118770.2.1 | (292) | KNVFYWFQNHKARERQKRRRQLESSANGNGNGGGGDDQSQ |
| Eucgr.B00945.1 | (284) | KNVFYWFQNHKARERQKRRRQMEAGPE------------E |
| Glyma07g11370.1 | (294) | KNVFYWFQNHKARERQKRRRQMESDAE------------- |
| Glyma09g30830.1 | (298) | KNVFYWFQNHKARERQKRRRQMESDAE------------- |
| Glyma05g33850.1 | (288) | KNVFYWFQNHKARERQKRRRQMESAAE----------GHH |
| Glyma08g05830.1 | (286) | KNVFYWFQNHKARERQKRRRQMDTLEK------------K |
| GSVIVT01008424001 | (290) | KNVFYWFQNHKARERQKRRRQLEPDEQ------------- |
| POPTR_0012s04510.1 | (296) | KNVFYWFQNHKARERQKRRRQMESDSL--------DDHQQ |
| POPTR_0015s04520.1 | (300) | KNVFYWFQNHKARERQKRRRQMESDSF--------DGHLQ |
| LOC_Os01g62310.1 | (316) | KNVFYWFQNHKARQRQK--QKQQSFDY---------FSKL |
| GRMZM2G108933_T01 | (322) | KNVFYWFQNHKARQRQR--QKQDSFAY---------FSRL |
| Si004427m | (318) | KNVFYWFQNHKARQRQK--QKQDSFAY---------FTRL |
| AT5G59340.1 | (306) | KNVFYWFQNHKARQRQK--QKQERMAY------------- |
| POPTR_0001s24470.1 | (328) | KNVFYWFQNHKARQRQK--QKQENMAY------------- |
| POPTR_0009s03460.1 | (326) | KNVFYWFQNHKARQRQK--QKQESMAY------------- |
| Eucgr.B02379.1 | (314) | KNVFYWFQNHKARQRQK--EKQESLAY------------- |
| Solyc06g076000.1.1 | (312) | KNVFYWFQNHKARQRQK--QKQDKFAY------------- |
| Glyma11g14940.1 | (308) | KNVFYWFQNHKARQRQK--QKQETFAY------------- |
| Glyma13g41000.1 | (320) | KNVFYWFQNHKARQRQKL-MKQQTIAY------------- |
| Glyma15g04460.1 | (324) | KNVFYWFQNHKARQRQKLKQKQQSIAY------------- |
| Consensus | (519) | KNVFYWFQNHKARXRQX |

FIG. 19E

```
Glyma20g02160.1        (304)  -------------------------GVKETK-KWASTS
AT3G18010.1            (282)  LSTASLVSNHGFDKKDPPGY-------KVEQVK-NWICSV
POPTR_0010s12150.1     (310)  -TDHESSNKMKESGPRRTVL-------GVDQTN-NLA-PH
GSVIVT01011738001      (302)  QQRDNGSLERKESVLRRTCI-------EVEQTK-NWVVPS
Solyc03g118770.2.1     (292)  SNCNAENAERKESGANRTVF-------EIEQTK-HWPSPT
Eucgr.B00945.1         (284)  PNRDAEESERKETGASRTGL-------EVEETKNNWA-PP
Glyma07g11370.1        (294)  ------TPEKKDLGICRLYL-------QVGQCL-KLNGPR
Glyma09g30830.1        (298)  ------PPEKKDLAASRTVF-------EVERTK-NWT-PS
Glyma05g33850.1        (288)  TRDFDSTLEKKDLGASRTVF-------EVDQTK-NWA-PS
Glyma08g05830.1        (286)  TSVTCFFAGMKETSNKRPCF-------AMHGLMASFA-QV
GSVIVT01008424001      (290)  -NRDVESTERKESGGSRTGF--------EEQTK-NWALST
POPTR_0012s04510.1     (296)  NGHGVEMFERKEPGASMTGY-------EGEQTR-NWA-PS
POPTR_0015s04520.1     (300)  NGHGIEIFERKESEASRTGY-------EGEQTK-NWA-PS
LOC_Os01g62310.1       (316)  FRRPPPLPVLHRPLARPFPL-------AMAPTAMPPPPPP
GRMZM2G108933_T01      (322)  LRRPPPLPVLSMPPAPPYHHARVPAPPAIPMPMAP--PPP
Si004427m              (318)  LRRPPPLPMLVRP-PGPLPY---------PHGRLPVPAPP
AT5G59340.1            (306)  --------------FNRLLH-------KTSRF--FYP-PP
POPTR_0001s24470.1     (328)  --------------INKYLH-------KAHQPV--FA-PP
POPTR_0009s03460.1     (326)  --------------INNYLH-------KVHQPV--FA-PP
Eucgr.B02379.1         (314)  --------------LNRYFH-------KSARTA--FH-PP
Solyc06g076000.1.1     (312)  --------------YNRFLH----------RTS-VFP-PP
Glyma11g14940.1        (308)  --------------FNRFLH-------TPQP---FFS-PP
Glyma13g41000.1        (320)  --------------SNRFLR-------ASH--------PI
Glyma15g04460.1        (324)  --------------CNCFLH-------ASH--------PI
```

FIG. 19F

```
Glyma20g02160.1         (304)  -----NCSGHAE-----------------------
AT3G18010.1             (282)  -----GCDT-----------------------QPEKPSRD
POPTR_0010s12150.1      (310)  ----SKCSTDHVEGPVS---------------VNGAAIAE
GSVIVT01011738001       (302)  ----SNCSTLSEESVSI---------------QRAAVAE
Solyc03g118770.2.1      (292)  -----NCSTLAEKTAAKTKAGAASAAAGATAAGVAESCRV
Eucgr.B00945.1          (284)  ----INCSTLAEEPAGA--TTQKAPKAGSAATLAERRTRS
Glyma07g11370.1         (294)  ----------------------------------------
Glyma09g30830.1         (298)  ----TNCST-------------------------------
Glyma05g33850.1         (288)  ----TNCSTLAEESVSI-------------QRAAKAAIAE
Glyma08g05830.1         (286)  ----GQC---------------------------------
GSVIVT01008424001       (290)  -----NCSILAEESLSI-------------QRAAKATAAAE
POPTR_0012s04510.1      (296)  ----TNCSTLSEESVSI-------------SKATKAAMAEY
POPTR_0015s04520.1      (300)  ----TNCSTLSEESVSI-------------SRATKGAMAEY
LOC_Os01g62310.1        (316)  PATTTTAAC-------------------------------
GRMZM2G108933_T01       (322)  ----AACND-------------------------------
Si004427m               (318)  AAAAAACSSSNGGTHVV-----------------------
AT5G59340.1             (306)  ------CSN-------------------------------
POPTR_0001s24470.1      (328)  ------CRN-------------------------------
POPTR_0009s03460.1      (326)  ------CAN-------------------------------
Eucgr.B02379.1          (314)  ------CPN-------------------------------
Solyc06g076000.1.1      (312)  -----NCPN-------------------------------
Glyma11g14940.1         (308)  -----ICPN-----------------------GSPI
Glyma13g41000.1         (320)  ------CQN-------------------------------
Glyma15g04460.1         (324)  ------CQN-------------------------------
Glyma20g02160.1         (304)  ---------GLGEIKDKAK--------------NQFSFT
```

FIG. 19G

```
AT3G18010.1            (282)  YHLEEPANIRVEHNARCGGDERRSFLGINTTWQMMQLPPS
POPTR_0010s12150.1     (310)  SGTHGWSEFEERELQQMKS----ISLDMHAMWQTMDL-SS
GSVIVT01011738001      (302)  SRTDVWFQFEERELQQTRS-----TVERQATWQLMGL-TS
Solyc03g118770.2.1     (292)  AAAERWIPFDEGE--QRRS----LLAERNATWQMMHL-SC
Eucgr.B00945.1         (284)  SSSDQWIKFDDGEFQWTRRHSASNFLERNATWQMMQLPSC
Glyma07g11370.1        (294)  ---------------TGHPQQIAVLLQRSNNIPFLIS-CF
Glyma09g30830.1        (298)  --------MAEQKVHKHDP---------------------
Glyma05g33850.1        (288)  CRTDGWLQFDEGELQHRRN-----FMERNATWHMMQL-SC
Glyma08g05830.1        (286)  -------------LKLNRP-------------------RT
GSVIVT01008424001      (290)  CRTDGWIQFDEGELQHRRS-----LVERNAIWQMMQL-SC
POPTR_0012s04510.1     (296)  YRPDGWIEFDEGEIMQHRR----NLIERNATWEMMPF-SC
POPTR_0015s04520.1     (300)  CRPDGWMQLDEGELQHRRN-----FIERNATWEMMQL-SC
LOC_Os01g62310.1       (316)  ---------NAGGVMFRTP----SFMPVAT-----NN-AS
GRMZM2G108933_T01      (322)  --------NGGARVIYRNP----FYVA-APQAPPANA-AY
Si004427m              (318)  ---EWINASFLAAVMYRSP----FYMPAAPQAPAANA-LY
AT5G59340.1            (306)  --------------VGCVSP----YYLQQASDHHMNQH-GS
POPTR_0001s24470.1     (328)  --------------VVNSP----CYLPKSD---IMGL-CQ
POPTR_0009s03460.1     (326)  --------------VVCSP----YFPQQSE---VMGF-CQ
Eucgr.B02379.1         (314)  --------------AVCGP----YFVPQSDI-------GT
Solyc06g076000.1.1     (312)  -----------GFVVVCSP----YYTAQNN----LGF-YQ
Glyma11g14940.1        (308)  MIDGQLFLLLFFFKTMCAP----YYIPQGQ----GEI-GF
Glyma13g41000.1        (320)  --------------VACAP----YCLQRSG--------FS
Glyma15g04460.1        (324)  --------------VVCAP----YCLQKSG--------FS
```

FIG. 19H

```
Glyma20g02160.1         (304)  RYS-------------------------------ESVFTL
AT3G18010.1             (282)  FYS---------SSHHHQRNLILNSPTVSSNMSNSNNAV
POPTR_0010s12150.1      (310)  STP---------------------------VHRLTSTMT
GSVIVT01011738001       (302)  SPP---------------------------SQLIDTITTT
Solyc03g118770.2.1      (292)  SPPTINNNTNCATICSNTITTATCTPIIRSCPSTPTTIDH
Eucgr.B00945.1          (284)  PHP--------THLINTTAPSTVAPPATPSLLSAAARASS
Glyma07g11370.1         (294)  SYP-------------------------------LSGDY
Glyma09g30830.1         (298)  ----------------------------------------
Glyma05g33850.1         (288)  PPP---------PTVSPHLINTSPITSTTSMATATTVTAR
Glyma08g05830.1         (286)  GHP--------------------------------LQTAV
GSVIVT01008424001       (290)  PSP----------------TTHLINTTTTRTKEAAAVR
POPTR_0012s04510.1      (296)  PSP-------THLLNTISSATATTIATTSASTQGAATVRT
POPTR_0015s04520.1      (300)  PSP----------------THQRNTISSTSSTTTMSKQG
LOC_Os01g62310.1        (316)  YYP-------------QQQTPLLYPGMEVCPHDKSTAQPP
GRMZM2G108933_T01       (322)  YYP--------------------------QPQQQQQQVTV
Si004427m               (318)  YHP---------QHQHQVPASVMYPRMEVAQDKMIPAAAQ
AT5G59340.1             (306)  VYT-----NDLLHRNNVMIPSGGYEKRTVTQHQKQLSDIR
POPTR_0001s24470.1      (328)  QHQ----------------------------NMLLPGNFK
POPTR_0009s03460.1      (326)  QHP----------------------------KMLLPSNFK
Eucgr.B02379.1          (314)  MYP--------------------QCPKVLLPCGIKRRQK
Solyc06g076000.1.1      (312)  QYP-------------------------AVPSMIIPGPGG
Glyma11g14940.1         (308)  YPP---------------------------HQKVFVPVG
Glyma13g41000.1         (320)  FYP--------------------------------QQSKV
Glyma15g04460.1         (324)  FYP------------------------------HQPKVLAS
```

FIG. 19I

```
Glyma20g02160.1      (304) LLDGELMSVNSEVCEFSPSPF-------------------
AT3G18010.1          (282) SASKDTVTVSPVFLRTREATNTETCH---RNGDDNKDQEQ
POPTR_0010s12150.1   (310) TTASKFSSLEEHSSLLRPTKTATHAN--------------
GSVIVT01011738001    (302) TVAEALNTIYPKQKPLSPQSLRPNTH--------------
Solyc03g118770.2.1   (292) QTKQLFKPKDHLNIFITPFRCDQKHQ----------NIIG
Eucgr.B00945.1       (284) MDPNKILKAHELRSFFMSSPFRDDHD-----------LAS
Glyma07g11370.1      (294) WQMITRDQVDMGNMYIMERSALGIGK--------------
Glyma09g30830.1      (298) -----LNQVDMGNMYIMERSALGIGK--------------
Glyma05g33850.1      (288) LMDPKLIKTHDLSFFTS--PNRENGI-----------IHL
Glyma08g05830.1      (286) LLQRSIILHPPLSLSLFMDCLIFCYT--------------
GSVIVT01008424001    (290) RMDPKFIKTRDLNIFIAPYRSEGHNH----------LAGV
POPTR_0012s04510.1   (296) MDPTKLMNAHDLNIFIA--PYIENGYHGARINHFNNSVIN
POPTR_0015s04520.1   (300) AAAAKLIKAHDLNVFIA--PYRENGHHGALINQFNSSVIN
LOC_Os01g62310.1     (316) ATTTMYLQAPPSSAHLAAAAGRGAAE-------------A
GRMZM2G108933_T01    (322) MYQYPRMEVAGQDKMMTRAAAHQQQQ-----------HNG
Si004427m            (318) HNHHHHRHHPAAGAMYHAAAAGNNAS------TTPMHVLH
AT5G59340.1          (306) TTAATRMPISPSSLRFDRFALRDNCY--------------
POPTR_0001s24470.1   (328) RRSRSETISYAFKGYDQEAVLREYHN------HITKNKFE
POPTR_0009s03460.1   (326) MRPRSEARTYAFNGYEPAAPYGYHNR------ITMNKGER
Eucgr.B02379.1       (314) TDFVERTKTFCRTGFAYPAHPQGHHH-------DVTFHQT
Solyc06g076000.1.1   (312) FKRRATCNQETLNLCEQNNSPNANKE--------------
Glyma11g14940.1      (308) FRRSPSEKVVPTGMISSNGPLVYEGM---------HQMQQ
Glyma13g41000.1      (320) LASGGISSTGPLGMQRMFDGMQSSEH--------------
Glyma15g04460.1      (324) VGISSRIETGSFGMLRICDGMQSEHP--------------
```

FIG. 19J

```
Glyma20g02160.1        (304)  --------------FLSLFYLFF----------------
AT3G18010.1            (282)  HEDCSNGELDHQEQTLELFPLRKEGFC-------------
POPTR_0010s12150.1     (310)  -----HDGEIREVQTLQLFPLCSDDGN----------GAN
GSVIVT01011738001      (302)  -----LEHETRESQTLQLFPVQGGQSF----------NAA
Solyc03g118770.2.1     (292)  DEEEGEGNGHEAQTLELFPLRSSNDN----------NDE
Eucgr.B00945.1         (284)  GGGGGGRECEEDSQTLQLFPLRSGDDF-------------
Glyma07g11370.1        (294)  ---------GPNKSFVC-WEMKMA----------------
Glyma09g30830.1        (298)  ---------VPNKSFLCFWGLCCAHS--------------
Glyma05g33850.1        (288)  SSISTQDDNSVESQTLQLFPTRNADRS----------SDN
Glyma08g05830.1        (286)  ---------------MQLYLKLGVH---------------
GSVIVT01008424001      (290)  GADHSNEEEGGESQTLQLFPLRSGDGN-------------
POPTR_0012s04510.1     (296)  EGGEYCRDGNDESQTLQLFPIRSGGNG----------NN
POPTR_0015s04520.1     (300)  DGDESR-GGTGESQTLQLFPLRSGGDG----------NNN
LOC_Os01g62310.1       (316)  EGHGRRGGGAGGRETLQLFPLQPTFVL----------PDH
GRMZM2G108933_T01      (322)  AGQQPGRAGHPSRETLQLFPLQPTFVLRHDKGRAANGSNN
Si004427m              (318)  FPPAAAVDAGPSRETLQLFPLQPTFLL----------PAD
AT5G59340.1            (306)  -AGEDINVNSSGRKTLPLFPLQPLNAS----------NA
POPTR_0001s24470.1     (328)  RSPVTIDKSSSDQETLPLFPLHPTGIL----------EGA
POPTR_0009s03460.1     (326)  TLVTINHKSSSDQATLPLFPLHPTGTL----------EGA
Eucgr.B02379.1         (314)  AESNNDSTVERNQETLDLFPLHPTGRA----------VQD
Solyc06g076000.1.1     (312)  ---------FITQETLNLFPLHPTGVL----------QEK
Glyma11g14940.1        (308)  RISDCSNSHFSHQETLDLFPLHPTGIL-------------
Glyma13g41000.1        (320)  --------PDCNREVLTLFPLHPTGIL------------K
Glyma15g04460.1        (324)  ----DYNYSTSNREALTLFPLHPTGIL----------EEK
```

FIG. 19K

```
Glyma20g02160.1      (304) ----------------------------------------
AT3G18010.1          (282) ------SDGEKDKNISGI----------------------
POPTR_0010s12150.1   (310) GTN---NDRNVPIRTINT----TFTP--------------
GSVIVT01011738001    (302) NEIISVAEMENGLPITTI--DTNFTP--------------
Solyc03g118770.2.1   (292) NNFSDKDEIGAAANLNNNFNGSH-----------------
Eucgr.B00945.1       (284) -------DGKSASPPSHH-------Q--------------
Glyma07g11370.1      (294) ----------------------------------------
Glyma09g30830.1      (298) --------CHLEINLNQQLLIIKFIS--------------
Glyma05g33850.1      (288) INQ--QKETEVSVSAMNA-------P--------------
Glyma08g05830.1      (286) --------ANLKSVLLSN----------------------
GSVIVT01008424001    (290) -ENINEKEGEISVAAMNT----NLTP--------------
POPTR_0012s04510.1   (296) IERINERETEVSVSATETLNANDFSP--------------
POPTR_0015s04520.1   (300) IESINERESEVSVSAAEALNANNFAP--------------
LOC_Os01g62310.1     (316) KPLRAGSACAAVSPTTPSASASFSWESESSDSPSSEA---
GRMZM2G108933_T01    (322) DSLTSTSTATATATATATASASISEDSDGLESGSSGKGVE
Si004427m            (318) KGRAAGGGASMAPAPSTASASFSGESESLEESPDSYSEAL
AT5G59340.1          (306) DGMGSSSFALGSDSPVDCSSDGAGRE--------------
POPTR_0001s24470.1   (328) SPIFSHG-STSAENSINTPISSEITHGIGEHSADH-----
POPTR_0009s03460.1   (326) TSICPVGSTDPAENSTNTPSSSEITTGIEEHSGDC-----
Eucgr.B02379.1       (314) TSKCSQADHDCSRADQDCSATTSTSSSSEARDGGNNGD--
Solyc06g076000.1.1   (312) TTIADSSSSSSTCVPRDHLSSNTTSNSVEVNCFTDLGIGA
Glyma11g14940.1      (308) ---------EGKTTTTTX----------------------
Glyma13g41000.1      (320) EKTTHQVPSLASTSVVAVDEDGHLGN--------------
Glyma15g04460.1      (324) TTHHSVDVTDKSFVSIAVDENGHLGN--------------
```

FIG. 19L

```
Glyma20g02160.1       (304)  ----SLFFSF------------------
AT3G18010.1           (282)  ----HCFYEFLPLKN-------------
POPTR_0010s12150.1    (310)  ----SQFFEFLPLKN-------------
GSVIVT01011738001     (302)  ----NQFFEFL-----------------
Solyc03g118770.2.1    (292)  ----YQFFEFLPLKN-------------
Eucgr.B00945.1        (284)  ----HQFFEFLPLKN-------------
Glyma07g11370.1       (294)  ----------------------------
Glyma09g30830.1       (298)  ----KCVQKLL-----------------
Glyma05g33850.1       (288)  ----SQFFEFLPLKN-------------
Glyma08g05830.1       (286)  ----NNFFTFALW---------------
GSVIVT01008424001     (290)  ----HQFFEFLPLKN-------------
POPTR_0012s04510.1    (296)  ----CQFFEFLPLRI-------------
POPTR_0015s04520.1    (300)  ----CQFFEFLPLKH-------------
LOC_Os01g62310.1      (316)  ----PPFYDFFGVHSGGR----------
GRMZM2G108933_T01     (322)  EAPALPFYDFFGLQSSGGR---------
Si004427m             (318)  A---VPFYDFFGLQSGGR----------
AT5G59340.1           (306)  ----QPFIDFFSGGSTSTRFDSNGNGL
POPTR_0001s24470.1    (328)  ----KPFFDFFSEKDPFESSH-------
POPTR_0009s03460.1    (326)  ----KPFFDFFYGKDS------------
Eucgr.B02379.1        (314)  ----QPFFDFFSANGCFCERD-------
Solyc06g076000.1.1    (312)  SDRPQPVFNFLCGN--------------
Glyma11g14940.1       (308)  ----------------------------
Glyma13g41000.1       (320)  ----QPFFNFFTTEPRSRE---------
Glyma15g04460.1       (324)  ----QPCFNFQY----------------
```

FIG. 19M

RESOURCE USE EFFICIENCY IMPROVEMENT IN PLANTS

CROSS REFERENCE TO RELATED APPLICATIONS

This application incorporates by reference in its entirety, and is a National Phase of, International Patent Application No. PCT/US2014/063345 filed on 31 Oct. 2014 (pending), which claims priority from U.S. Provisional Patent Application No. 61/900,224, filed on 5 Nov. 2013, which is incorporated by reference herein in its entirety.

FIELD OF THE INVENTION

The present invention relates to plant genomics and plant improvement.

BACKGROUND OF THE INVENTION

A plant's phenotypic characteristics that enhance photosynthetic resource use efficiency may be controlled through a number of cellular processes. One important way to manipulate that control is by manipulating the characteristics or expression of regulatory proteins, proteins that influence the expression of a particular gene or sets of genes. For example, transformed or transgenic plants that comprise cells with altered levels of at least one selected regulatory polypeptide may possess advantageous or desirable traits, and strategies for manipulating traits by altering a plant cell's regulatory polypeptide content or expression level can result in plants and crops with commercially valuable properties. Examples of such trait manipulation include:

Increasing Canopy Photosynthesis to Increase Crop Yield.

Recent studies by crop physiologists have provided evidence that crop-canopy photosynthesis is correlated with crop yield, and that increasing canopy photosynthesis can increase crop yield (Long et al., 2006. *Plant Cell Environ.* 29:315-33; Murchie et al., 2009 *New Phytol.* 181:532-552; Zhu et al., 2010. *Ann. Rev. Plant Biol.* 61:235-261). Two overlapping strategies for increasing canopy photosynthesis have been proposed. The first recognizes great potential to increase canopy photosynthesis by improving multiple discrete reactions that currently limit photosynthetic capacity (reviewed in Zhu et al., 2010. supra). The second focuses upon improving plant physiological status during environmental conditions that limit the realization of photosynthetic capacity. It is important to distinguish this second goal from recent industry and academic screening for genes to improve stress tolerance. Arguably, these efforts may have identified genes that improve plant physiological status during severe stresses not typically experienced on productive acres (Jones, 2007. *J. Exp. Bot.* 58:119-130; Passioura, 2007. *J. Exp. Bot.* 58:113-117). In contrast, improving the efficiency with which photosynthesis operates relative to the availability of key resources of water, nitrogen and light, is thought to be more appropriate for improving yield on productive acres (Long et al., 1994. *Ann. Rev. Plant Physiol. Plant Molec. Biol.* 45:633-662; Morison et al., 2008. *Philosophical Transactions of the Royal Society B: Biological Sciences* 363:639-658; Passioura, 2007, supra).

Improving Water Use Efficiency (WUE) to Improve Yield.

Freshwater is a limited and dwindling global resource; therefore, improving the efficiency with which food and biofuel crops use water is a prerequisite for maintaining and improving yield (Karaba et al., 2007. *Proc. Natl. Acad. Sci. USA.* 104:15270-15275). WUE can be used to describe the relationship between water use and crop productivity over a range of time integrals. The basic physiological definition of WUE equates the ratio of photosynthesis (A) to transpiration (T) at a given moment in time, also referred to as transpiration efficiency. However, the WUE concept can be scaled significantly, for example, over the complete lifecycle of a crop, where biomass or yield can be expressed per cumulative total of water transpired from the canopy. Thus far, the engineering of major field crops for improved WUE with single genes has not yet been achieved (Karaba et al., 2007. supra). Regardless, increased yields of wheat cultivars bred for increased transpiration efficiency (the ratio of photosynthesis to transpiration) have provided important support for the proposition that crop yield can be increased over broad acres through improvement in crop water-use efficiency (Condon et al., 2004. *J. Exp. Bot.* 55:2447-2460).

Estimates of water-use efficiency integrated over the life of plant tissues can be derived from analysis of the ratio of the $^{13}C$ carbon isotope to the $^{12}C$ carbon isotope in those tissues. The theory that underlies this means to estimating WUE is that during photosynthesis, incorporation of $^{13}C$ into the products of photosynthesis is slower than the lighter isotope $^{12}C$. Effectively, $^{13}C$ is discriminated against relative to $^{12}C$ during photosynthesis, an effect that is integrated over the life of the plant resulting in biomass with a distinct $^{13}C/^{12}C$ signature. Of the many steps in the photosynthetic process during which this discrimination occurs, discrimination at the active site of Rubisco is of most significance, a consequence of kinetic constraints associated with the $^{13}CO_2$ molecule being larger. Significantly, the discrimination by Rubisco is not constant, but varies depending on the $CO_2$ concentration within the leaf. At high $CO_2$ concentration discrimination by Rubisco is highest, however as $CO_2$ concentration decreases discrimination decreases. Because the $CO_2$ concentration within the leaf is overwhelmingly dependent on the balance between $CO_2$ influx through the stomatal pore and the rate of photosynthesis, and because the stomatal pore controls the rate of transpiration from the leaf, the $^{13}C/^{12}C$ isotopic signature of plant material provides an integrated record of the balance between transpiration and photosynthesis during the life of the plant and as such a surrogate measure of water-use efficiency (Farquhar et al. 1989. *Annu. Rev. Plant Physiol. Plant Mol. Biol.* 40:503-537).

Improving Abiotic Stress Tolerance to Improve Yield.

Field grown crops experience abiotic stress over a continuum of severity, dictated by complex interaction between discrete environmental factors and drivers of stress that include, but are not limited to, speed of onset, duration and severity. Screening for genes to improve abiotic stress tolerance has not typically been sophisticated enough to target many places along this stress continuum. One result of this screening limitation was described above, a tendency to identify leads for stress tolerance unsuited to field relevant stress. For productive acres this stress is typically mild and frequent and can manifest as a constraint to photosynthesis experienced during the stress only. This type of stress is in contrast to damage and down regulation of photosynthesis in response to severe stress on more marginal farming acres, that will compromise rates of photosynthesis long after the stress has been relieved. Importantly, phenotypes that would be expected to protect against severe stress would be expected to compromise yield under benign environmental conditions. Soil water conservation, through decreased stomatal conductance and protection against light damage, through decreased leaf chlorophyll content are two such phenotypes. Both could compromise photosynthesis, however this cost would be short lived on marginal acres, where these phenotypes would also be expected to limit the severity of the stress experienced and result in faster recovery from stress. Over repeated stress cycles canopy photosynthesis and yield would be expected to increase. Consequently the ability to protect against long term down regulation of, or damaged to, the photosynthetic apparatus is considered a pathway to improving crop yield on more marginal lands where crop yield can be impacted by severe weather events.

With these needs in mind, new technologies for yield enhancement are required. In this disclosure, a phenotypic screening platform that directly measures photosynthetic capacity, water use efficiency, nitrogen use efficiency, and stress tolerance of mature plants was used to discover advantageous properties conferred by ectopic expression of the described regulatory proteins in plants.

SUMMARY

The instant description is directed to a transgenic plant or plants that have increased photosynthetic resource use efficiency or stress tolerance with respect to a control plant, or a plant part derived from such a plant, e.g., shoot vegetative organs/structures (e.g., leaves, stems and tubers), roots, flowers and floral organs/structures (e.g., bracts, sepals, petals, stamens, carpels, anthers and ovules), seed (including embryo, endosperm, and seed coat) and fruit (the mature ovary), plant tissue (e.g., vascular tissue, ground tissue, and the like), pulped, pureed, ground-up, macerated or broken-up tissue, and cells (e.g., guard cells, egg cells, etc.). In this regard, the transgenic plant or plants comprise a recombinant polynucleotide comprising a promoter of interest. The choice of promoter may include a constitutive promoter or a promoter with enhanced activity in a tissue capable of photosynthesis (also referred to herein as a "photosynthetic promoter" or a "photosynthetic tissue-enhanced promoter") such as a leaf tissue or other green tissue. Examples of photosynthetic promoters include for example, an RBCS3 promoter, an RBCS4 promoter or others such as the At4g01060 (also referred to as "G682") promoter, the latter regulating expression in a guard cell. The promoter regulates a polypeptide that is encoded by the recombinant polynucleotide or by a second (or target) recombinant polynucleotide (in which case expression of the polypeptide may be regulated by a trans-regulatory element). The promoter may also regulate expression of a polypeptide to an effective level of expression in a photosynthetic tissue, that is, to a level that, as a result of expression of the polypeptide to that level, improves photosynthetic resource use efficiency in a transgenic plant relative to a control plant. The recombinant polynucleotide may comprise the promoter and also encode the polypeptide or alternatively, the polynucleotide may comprise the promoter and drive expression of the polypeptide that is encoded by the second recombinant polynucleotide. In an exemplary embodiment, the polypeptide comprises a sequence listed in the sequence listing, or a sequence that is homologous, paralogous or orthologous to said polypeptide, being structurally-related to said polypeptide and having a function similar to said polypeptide as described herein. Expression of the polypeptide under the regulatory control of the constitutive or leaf-enhanced or photosynthetic tissue-enhanced promoter in the transgenic plant confers greater photosynthetic resource use efficiency to the transgenic plants, and/or water use efficiency to the transgenic plants, and may ultimately increase yield that may be obtained from the plants.

The instant description also pertains to methods for increasing photosynthetic resource use efficiency in, or increasing yield from, a plant or plants including the method conducted by growing a transgenic plant comprising and/or transformed with an expression cassette comprising the recombinant polynucleotide that comprises a constitutive promoter or a promoter expressed in photosynthetic tissue, which may be a leaf-enhanced or green tissue-enhanced promoter, such as for example, the RBCS3, RBCS4, At4g01060, or another photosynthetic tissue-enhanced promoter. Examples of photosynthetic tissue-enhanced promoters are found in the Sequence Listing or in Table 22. The promoter regulates expression of a polypeptide that comprises a polypeptide listed in the Sequence Listing. Recombinant polynucleotides encoding these clade polypeptides are described in the following paragraphs (a)-(c), and exemplary polypeptides within the clade are described in the following paragraphs (d)-(f) and are shown in the instant sequence alignments and Figures.

The recombinant polynucleotide that is introduced into a transgenic plant may encode a listed polypeptide sequence or encodes a polypeptide that is phylogenetically-related to a listed polypeptide sequence, including sequences that include:

(a) nucleic acid sequences that are at least 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95% or 96%, 97%, 98%, 99%, or about 100% identical to any of the listed polypeptides; and/or (b) nucleic acid sequences that encode polypeptide sequences that are at least 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95% or 96%, 97%, 98%, 99%, or about 100% identical in their amino acid sequences to the entire length to any of the listed polypeptides; and/or (c) nucleic acid sequences that hybridize under stringent conditions (e.g., hybridization followed by one, by two, or by more than two wash steps of 6× saline-sodium citrate buffer (SSC) and 65° C. for ten to thirty minutes per step) to any of the listed polynucleotides.

The listed polypeptides and polypeptides member of their protein clade may include:

(d) polypeptide sequences encoded by the nucleic acid sequences of (a), (b) and/or (c); and/or (e) polypeptide sequences that have at least 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65f %, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95% or 96%, 97%, 98%, 99%, or about 100% amino acid identity to any of the listed polypeptides, including SEQ ID NO: 2n, where n=1 to 164 (i.e., even integers 2, 4, 6, 8, . . . 328);

and/or at least 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65f %, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95% or 96%, 97%, 98%, 99%, or about 100 amino acid identity to a conserved domain of any of the listed polypeptides, including SEQ ID NO: 329 to 510; and/or (f) polypeptide sequences that comprise a subsequence that are at least 77%, 78%, 79%, 80%, 81%, 82%, 83%, 84%, 85%, 86%, 87%, 88%, 89%, 90%, 91%, 92%, 93%, 94%, 95% or 96%, 97%, 98%, 99%, or about 100% identical to any of the consensus sequences provided in the Sequence Listing, including SEQ ID NO: 511 to 519.

Expression of these polypeptides in the transgenic plant may confer increased photosynthetic resource use efficiency relative to a control plant. The transgenic plant may be selected for increased photosynthetic resource use efficiency or greater yield relative to the control plant. The transgenic plant may also be crossed with itself, a second plant from the same line as the transgenic plant, a non-transgenic plant, a wild-type plant, or a transgenic plant from a different line of plants, to produce a transgenic seed.

The instant description also pertains to methods for producing and selecting a crop plant with a greater yield than a control plant, the method comprising producing a transgenic plant by introducing into a target plant a recombinant polynucleotide that comprises a promoter, such as a leaf- or photosynthetic tissue-enhanced promoter that regulates a polypeptide encoded by the recombinant polynucleotide or a second recombinant polynucleotide, wherein the polypeptide comprises a polypeptide listed in the Sequence Listing, or a member of a clades of polypeptides phylogenetically related to a polypeptide listed in the Sequence Listing. A plurality of the transgenic plants is then grown, and a transgenic plant is selected that produces greater yield or has greater photosynthetic resource use efficiency than a control plant. The expression of the polypeptide in the selected transgenic plant confers the greater photosynthetic resource use efficiency and/or greater yield relative to the control plant. Optionally, the selected transgenic plant may be crossed with itself, a second plant from the same line as the transgenic plant, a non-transgenic plant, a wild-type plant, or a transgenic plant from a different line of plants, to produce a transgenic seed. A plurality of the selected transgenic plants will generally have greater cumulative canopy photosynthesis than the canopy photosynthesis of an identical number of the control plants.

The transgenic plant(s) described herein and produced by the instantly described methods may also possess one or more altered traits that result in greater photosynthetic resource use efficiency. The altered trait, relative to a control or reference plant, may include: increased photosynthetic capacity, increased photosynthetic rate, a decrease in leaf chlorophyll content, increased leaf transpiration efficiency, an increase in resistance to water vapor diffusion from the leaf exerted by stomata, an increase in total photoprotection resulting from non-photochemical quenching in the light harvesting antennae, an increase in the rate of relaxation of photoprotective reactions resulting from non-photochemical quenching operating in the light harvesting antennae, a decrease in the ratio of the carbon isotope $^{12}C$ to $^{13}C$ in above-ground biomass, and/or an increase in the total dry weight of above-ground plant material.

At least one advantage of greater photosynthetic resource use efficiency is that the transgenic plant, or a plurality of the transgenic plants, will have greater cumulative canopy photosynthesis than the canopy photosynthesis of an identical number of the control plants, or produce greater yield than an identical number of the control plants. A wide variety of transgenic plants are envisioned, including corn, wheat, rice, *Setaria, Miscanthus*, switchgrass, ryegrass, sugarcane, miscane, barley, sorghum, turfgrass, soy, cotton, canola, rapeseed, *Crambe, Camelina*, sugar beet, alfalfa, tomato, *Eucalyptus*, poplar, willow, pine, birch and other woody plants.

The instant description also pertains to expression vectors that comprise a recombinant polynucleotide that comprises a promoter expressed in photosynthetic tissue, for example, a constitutive promoter, or a leaf- or green tissue-enhanced promoter including the RBCS3, RBCS4, or At4g01060 promoters, or another photosynthetic tissue-enhanced promoter, for example, such a promoter found in the Sequence Listing or in Table 22, and a subsequence that encodes a polypeptide comprising a polypeptide sequence provided in the Sequence Listing or a member of the polypeptide clades of the polypeptide sequences listed in the Sequence Listing, or, alternatively, two expression constructs, one of which encodes a promoter such as a constitutive promoter, or a leaf-enhanced promoter or other photosynthetic tissue-enhanced promoter, and the second encodes a polypeptide sequence provided in the Sequence Listing or a member of the polypeptide clades of the polypeptide sequences listed in the Sequence Listing. In either instance, whether the polypeptide is encoded by the first or second expression constructs, the promoter regulates expression of the polypeptide by being responsible for production of cis- or trans-regulatory elements, respectively. In some embodiments, the expression vectors or cassettes comprise a promoter of the present application, and a gene of interest, wherein the promoter and the gene of interest do not link to each other under natural conditions, e.g., the linkage between the promoter and the gene of interest does not exist in nature.

The instant description is also directed to a method for producing a monocot plant with increased grain yield by providing a monocot plant cell or plant tissue with stably integrated, exogenous, recombinant polynucleotide comprising a promoter (for example, a constitutive, a non-constitutive, an inducible, a tissue-enhanced, or a photosynthetic tissue-enhanced promoter) that is functional in plant cells and that is operably linked to an exogenous or an endogenous nucleic acid sequence that encodes a listed polypeptide, that is expressed in a photosynthetic tissue of the transgenic plant to a level effective in conferring greater photosynthetic resource use efficiency relative to a control plant that does not contain the recombinant polynucleotide. A plant is generated from the plant cell or the plant tissue that comprises the recombinant polynucleotide, the plant is then grown and an increase in photosynthetic resource use efficiency or grain yield is measured relative to the control plant.

In the above paragraphs, the control plant may be exemplified by a plant of the same species as the plant comprising the recombinant polynucleotide, but the control plant does not comprise the recombinant polynucleotide that encodes a listed polypeptide of interest (e.g, the control plant may constitute an untransformed plant, or a transgenic plant line that comprises an "empty" nucleic acid vector, nucleic acid cassette, or marker gene wherein the vector does not comprise the recombinant polynucleotide or encode a listed polypeptide of interest).

BRIEF DESCRIPTION OF THE SEQUENCE LISTING AND DRAWINGS

The Sequence Listing provides exemplary polynucleotide and polypeptide sequences of the instant description. The traits associated with the use of the sequences are included in the Examples.

Incorporation of the Sequence Listing.

The Sequence Listing provides exemplary polynucleotide and polypeptide sequences. The copy of the Sequence Listing being submitted electronically with this patent application under 37 CFR § 1.821-1.825, is a read-only memory computer-readable file in ASCII text format. The Sequence Listing is named "MPS-0217P_ST25.txt", the electronic file of the Sequence Listing was created on Nov. 5, 2013, and is (868,673 bytes in size (848 megabytes in size as measured in MS-WINDOWS). The Sequence Listing is herein incorporated by reference in its entirety.

The phylogenetic trees that follow in FIG. 1B, FIG. 3, FIG. 8, FIG. 10, FIG. 12, FIG. 14, FIG. 16 and FIG. 18 were constructed using TreeBeST (Ruan et al., 2008. *Nucleic Acids Res.* 36 (suppl. 1): D735-D740) using the best command to identify the best tree from maximum likelihood and neighbor joining methods. Exemplary polypeptide clade member sequences that are closely-related to a canonical *Arabidopsis* sequence (shown in each tree in a rounded rectangle) each descend from a common ancestral sequence represented by a node designated with an arrow, which generally shows an ancient monocot-dicot divergence.

The protein sequence alignments that follow in FIGS. 2A-2J, FIGS. 5A-5I, FIGS. 9A-9M, FIGS. 11A-11L, FIGS. 13A-13K, FIGS. 15A-15O, FIGS. 17A-17T, and 19A-19M were generated with MUSCLE (3.8) with default parameters. The SEQ ID NOs: of each sequence appears in parentheses after each Gene Identifier (GID). Conserved domains are shown in boxes.

Figure 1B:
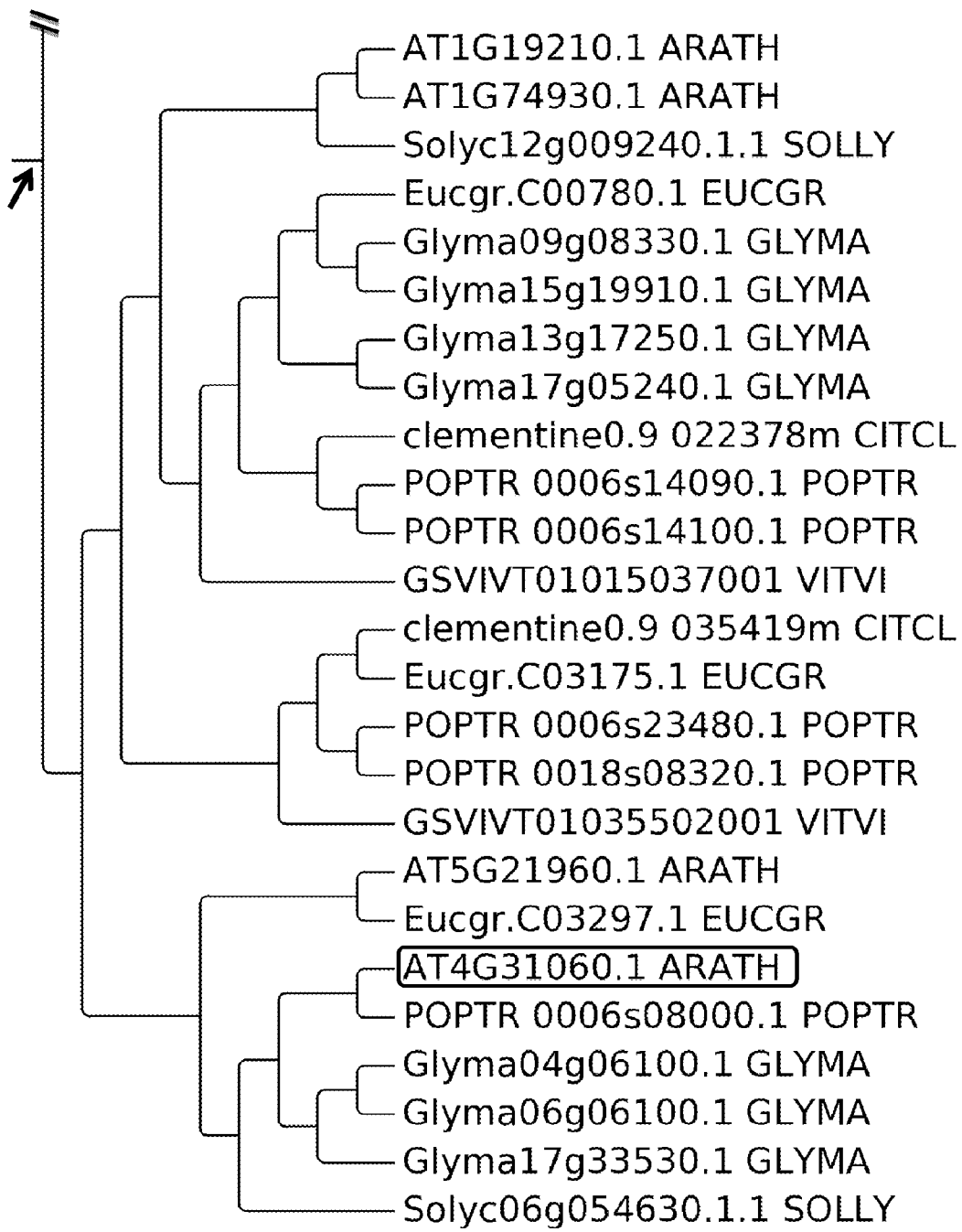

FIG. 1A-FIG. 1B: a phylogenetic tree of ERF015 or AT4G31060.1 (also referred to as G39) clade members and related full length proteins ERF015 clade members are considered those proteins that descended from an ancestral sequence designated by the arrow, including the exemplary sequences shown in this figure that are bounded by Bradi3g37544.1 and Solyc06g054630.1.1.

FIGS. 2A-2J show an alignment of Ethylene-Responsive transcription Factor 15 (AT4G31060.1; "ERF015") and representative clade-related proteins. The conserved AP2 domains appear in boxes in FIG. 2C and FIG. 2D. The consensus sequence derived from the listed conserved domains is presented as SEQ ID NO: 511.

Figure 3:
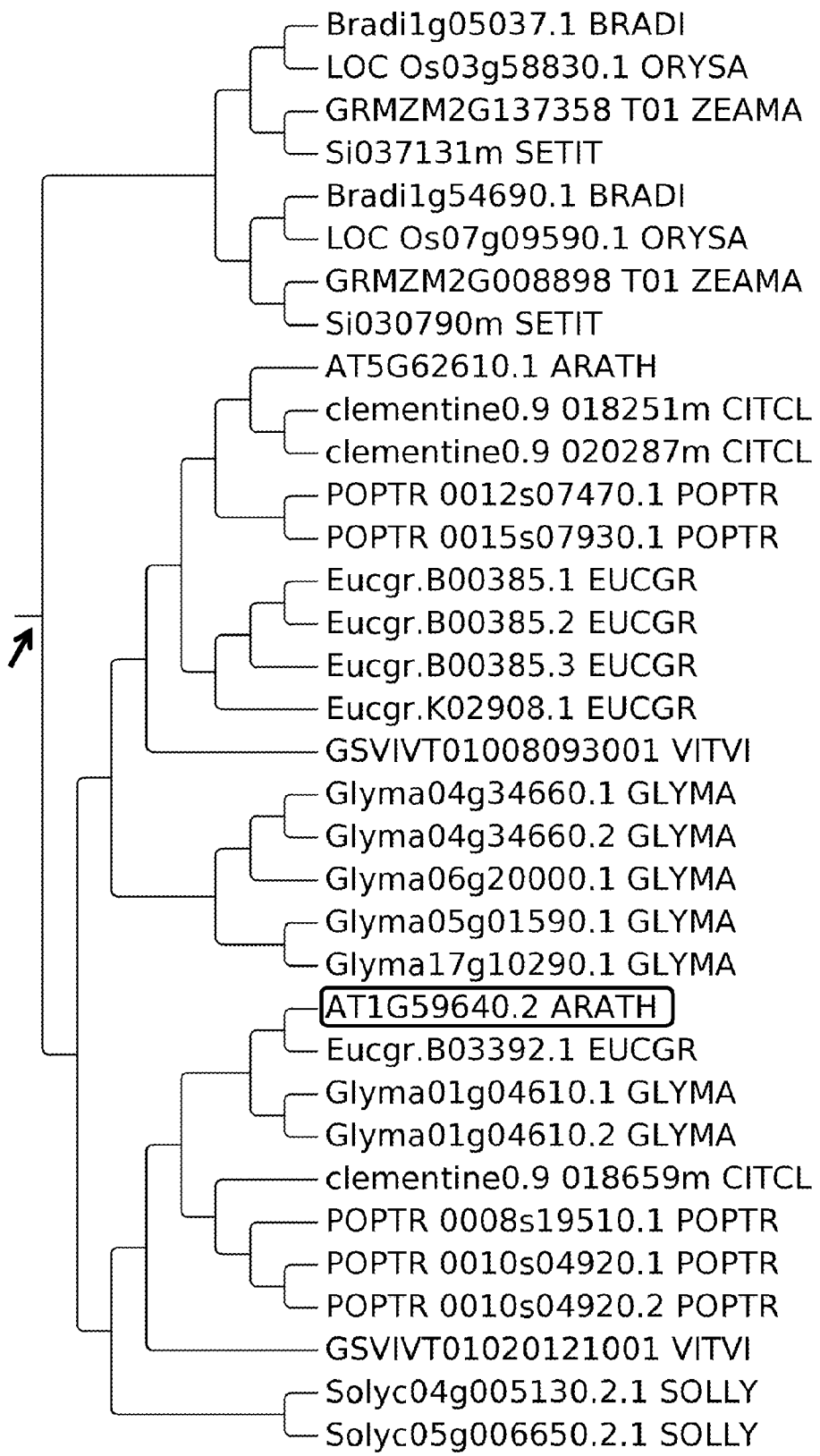

FIG. 3: a phylogenetic tree of AT1G59640.1 or AtbHLH031 (also referred to as G2520) clade members and related full length proteins. AtbHLH031 clade members are considered those proteins that descended from an ancestral sequence shown by the arrow, including the exemplary sequences shown in this figure that are bounded by Bradi1g05037.1 and Solyc05g006650.2.1.

Figure 4:
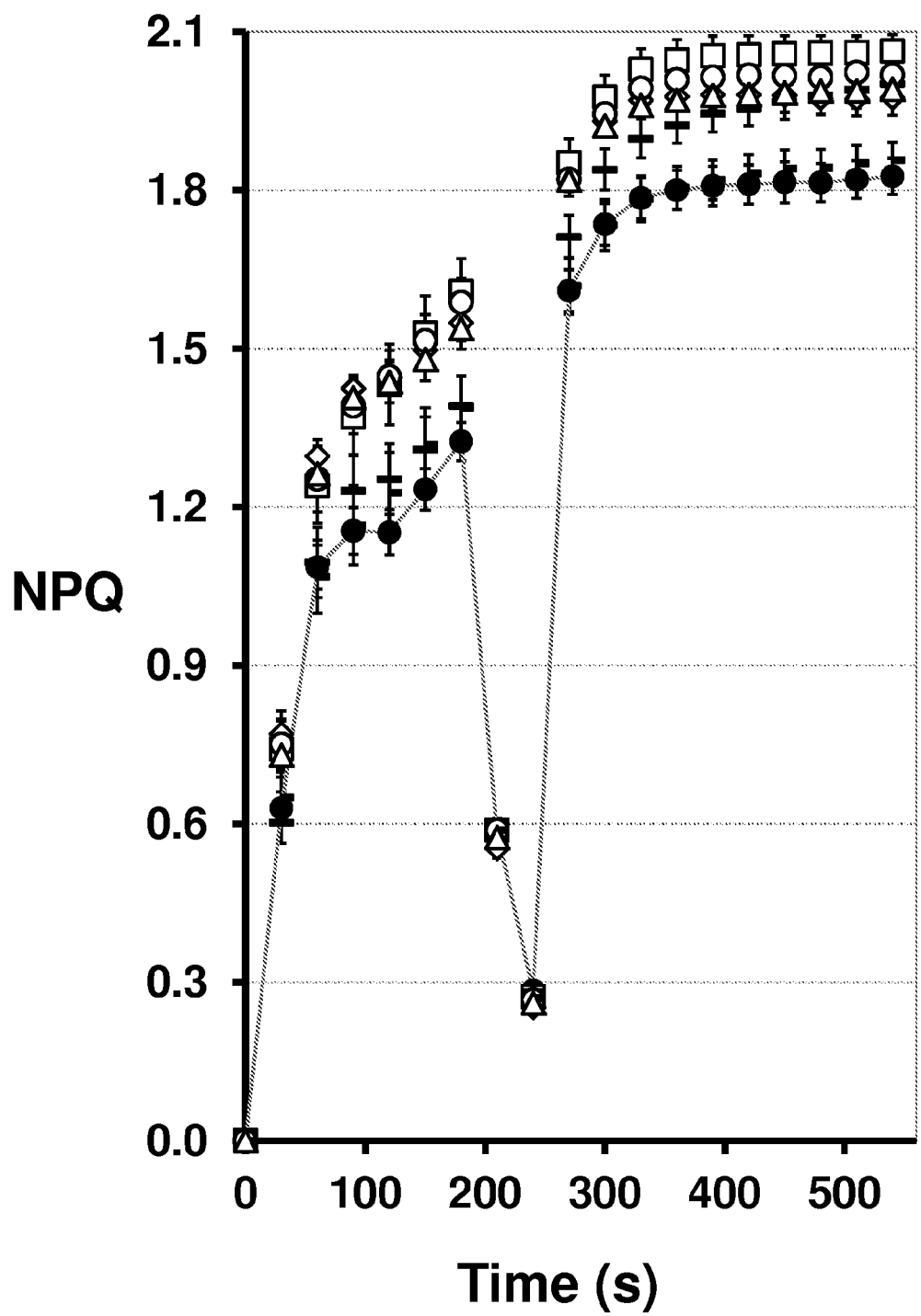

FIG. 4: Non-photochemical quenching (NPQ) dynamics at 22° C.: Plot showing increased NPQ in five AtbHLH031 overexpression lines, during short term acclimation to high light. NPQ was calculated from an initial measurement of maximal, dark adapted fluorescence ($F_m$) and subsequent measurements of fluorescence made under varying incident light ($F'_m$), as NPQ=($F_m/F'_m$)−1. During the nine minute assay $F'_m$ was measured at 30 second intervals: initially after exposure to 700 µmol PAR m$^{-2}$ s$^{-1}$ beginning immediately after $F_m$ was measured; then, after a decrease to 0 µmol PAR m$^{-2}$ s$^{-1}$ after 3 minutes; then, after an increase to 2000 µmol PAR m$^{-2}$ s$^{-1}$ after 4 minutes. All symbols are the mean±1 standard error of measurements made on at least 5 replicate leaves for a given line.

Legend for FIG. 4:
- ● Control
- □ Line 1
- ◇ Line 2
- ■ Line 3
- ○ Line 4
- .. Line 5
- Δ Line 6

FIGS. 5A-5I show an alignment of basic Helix-Loop-Helix 31 (AT1G59640.1; AtbHLH031) and representative clade-related proteins. The conserved bHLH domains appear in the boxes in FIG. 5E and continue through FIG. 5G. The consensus sequence derived from the listed conserved domains is presented as SEQ ID NO: 512.

Figure 6:
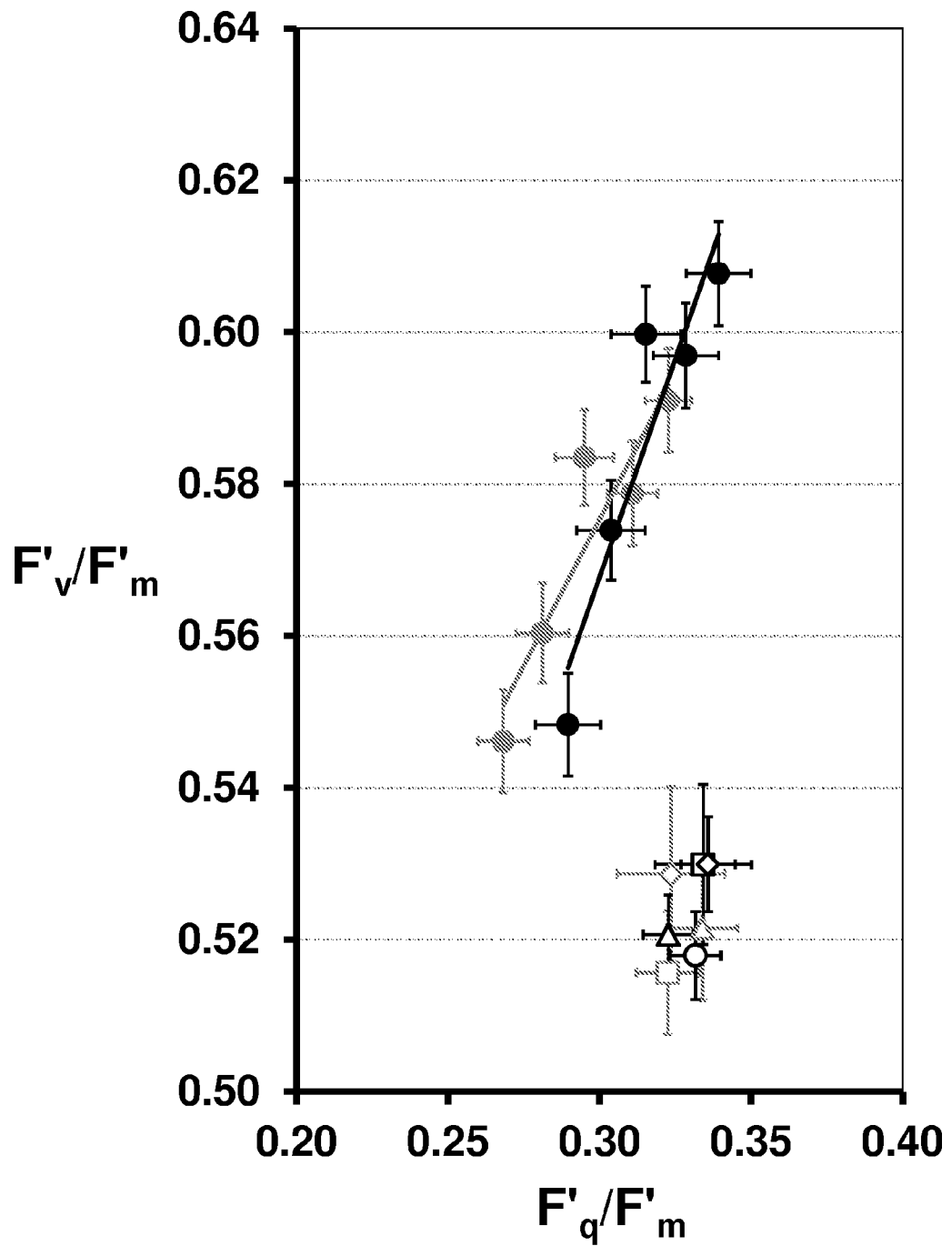

FIG. 6: Regulation of photosystem two: Plot showing a decrease in the maximum efficiency of photosystem two ($F'_v/F'_m$) operation in four NF-YC8 overexpression lines, repeatedly for three screened twice, when normalized to the same operating efficiency of PS2 in a control run in each of the two passes through the screen. When normalized to the same operating efficiency of PS2 ($F'_q/F'_m$), a decrease in the maximum efficiency of PS2 provides evidence of increased non-photochemical quenching in the NF-YC8 overexpression lines. All data were collected after 45 minutes acclimation to a light intensity of 700 µmol PAR m$^{-2}$ s$^{-1}$. All symbols are the mean±1 standard error of measurements made on at least 6 replicate plants for each line.

Legend for FIG. 6:
- ✱ 1st pass Control
- ▱ 1st pass Line 4
- △ 1st pass Line 5
- ◇ 1st pass Line 6
- ● 2nd pass Control
- □ 2nd pass Line 4
- Δ 2nd pass Line 5
- ◇ 2nd pass Line 6
- ○ 2nd pass Line 7

Figure 7:
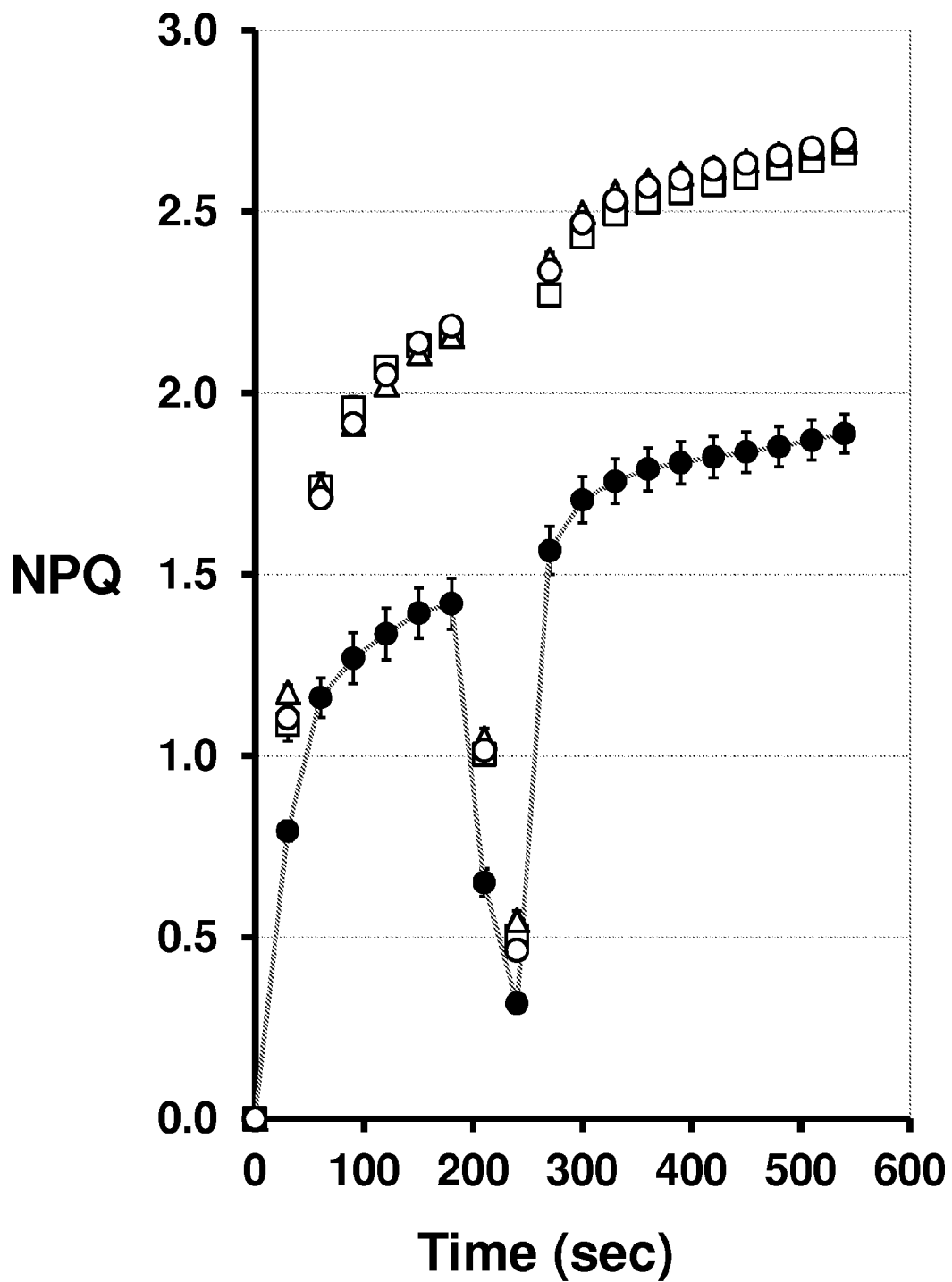

FIG. 7: Non-photochemical quenching (NPQ) dynamics: Plot showing increased NPQ in three NF-YC8 overexpression lines, during short term acclimation to high light. NPQ was calculated from an initial measurement of maximal, dark adapted fluorescence ($F_m$) and subsequent measurements of fluorescence made under varying incident light ($F'_m$), as NPQ=($F_m/F'_m$)−1. During the nine minute assay $F'_m$ was measured at 30 second intervals: initially after exposure to a light intensity of 700 µmol PAR m$^{-2}$ s$^{-1}$ beginning immediately after $F_m$ was measured; then, after a decrease to 0 µmol PAR m$^{-2}$ s$^{-1}$ after 3 minutes; then, after an increase to 2000 µmol PAR m$^{-2}$ s$^{-1}$ after 4 minutes. All symbols are the mean±1 standard error of measurements made on at least 6 replicate leaves for a given line.

Legend for FIG. 7:
- ● Control
- □ Line 1
- Δ Line 2
- ○ Line 3

Figure 8:
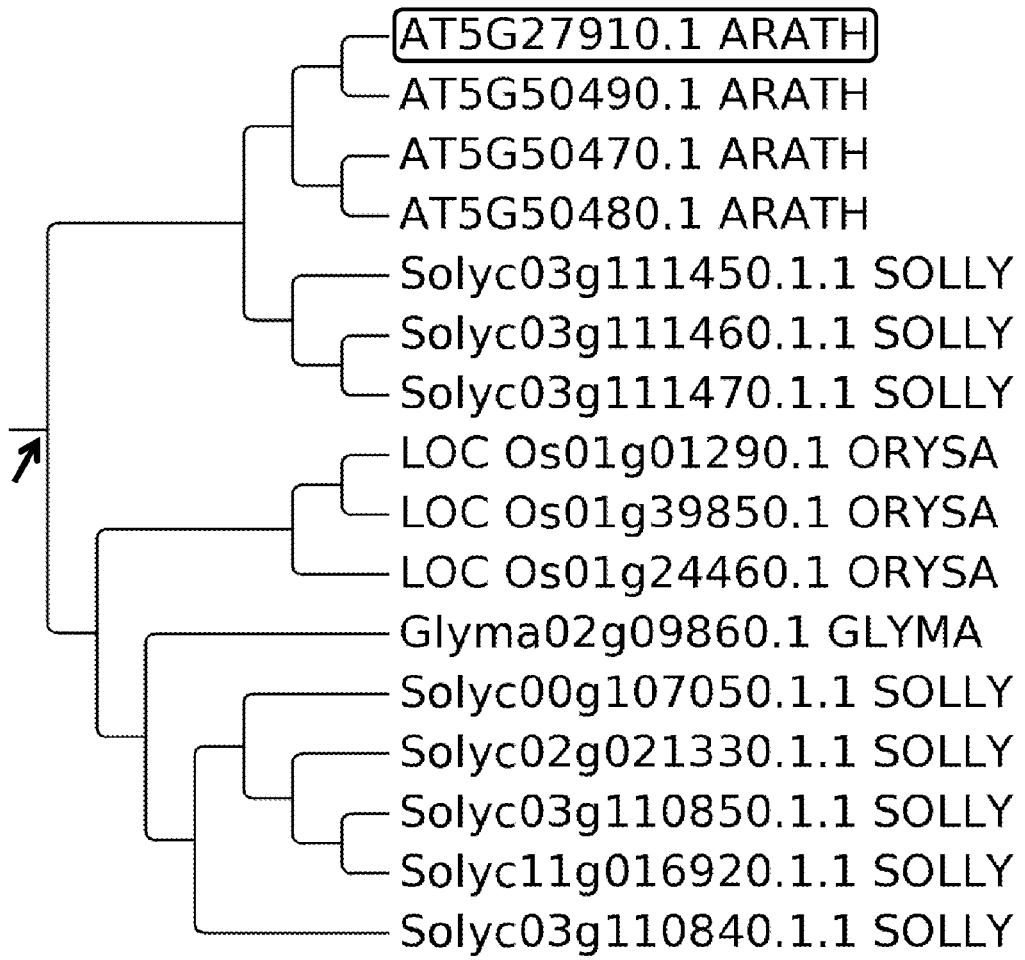

In FIG. 8: a phylogenetic tree of AT5G27910.1 or NF-YC8 (also referred to as G1836) clade members and related full length proteins. NF-YC8 clade members are considered those proteins that descended from an ancestral sequence shown by the arrow, including the exemplary sequences shown in this figure that are bounded by AT5G27910.1 and Solyc03g110840.1.1.

FIGS. 9A-9M show an alignment of CCAAT-box binding transcription factor NF-YC8 (AT5G27910.1; "Hap5a") and representative clade-related proteins. The conserved CBF/NF-Y domains appear in the boxes in FIG. 9C and continue through FIG. 9E. The consensus sequence derived from the listed conserved domains is presented as SEQ ID NO: 513.

Figure 10:
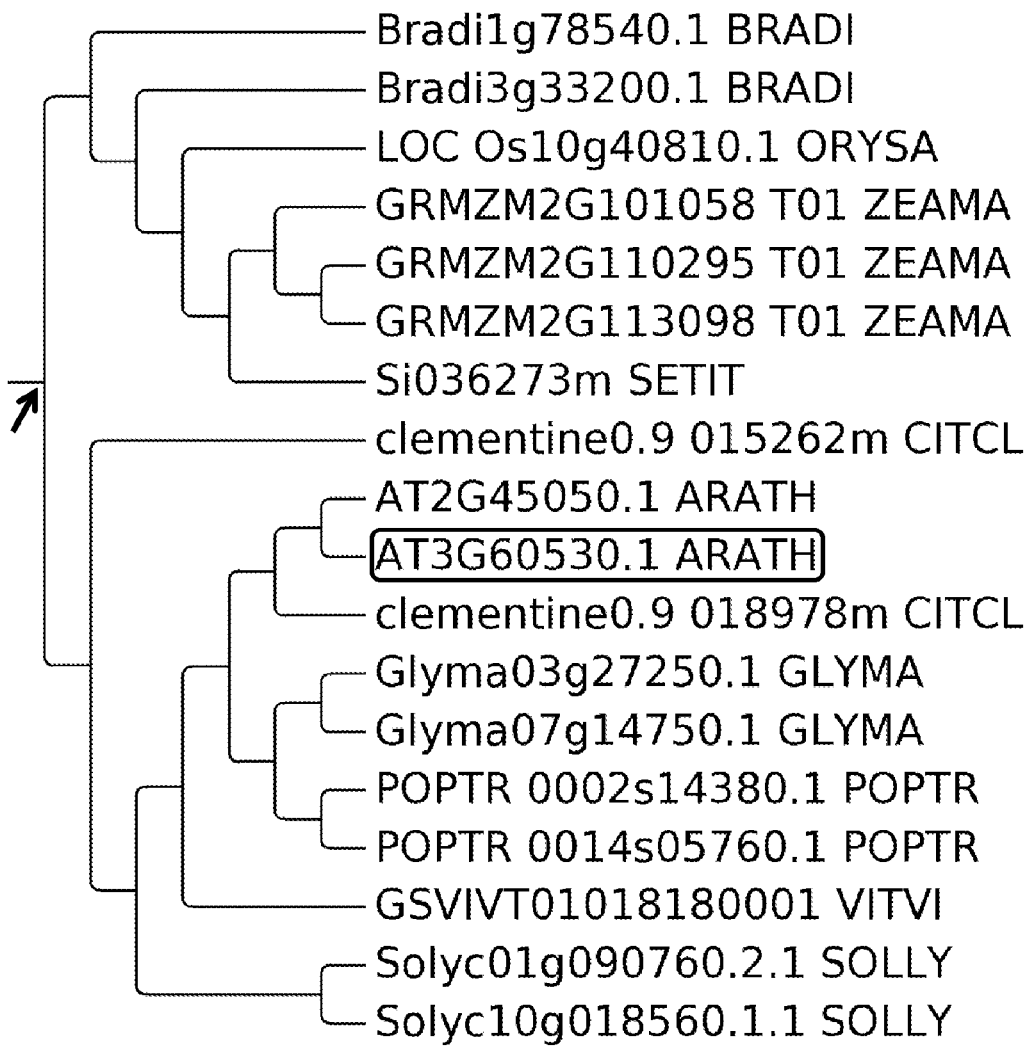

FIG. 10: a phylogenetic tree of AT3G60530.1 or "GATA4" (also referred to as G342) clade members and related full length proteins. GATA4 clade members are considered those proteins that descended from an ancestral sequence shown by the arrow, including the exemplary sequences shown in this figure that are bounded by Bradilg78540.1 and Solyc10g018560.1.1.

FIGS. 11A-11L show an alignment of GATA binding protein 4 (AT3G60530.1; "GATA4") and representative clade-related proteins. Conserved domains of unknown function appear in the box with the dashed border in FIG. 11E, and the GATA-Zinc finger domains appear in the boxes with solid borders in FIG. 11I and continue through FIG. 11K. The consensus sequences derived from the listed conserved domains are presented as SEQ ID NO: 514 and 515, respectively.

Figure 12:
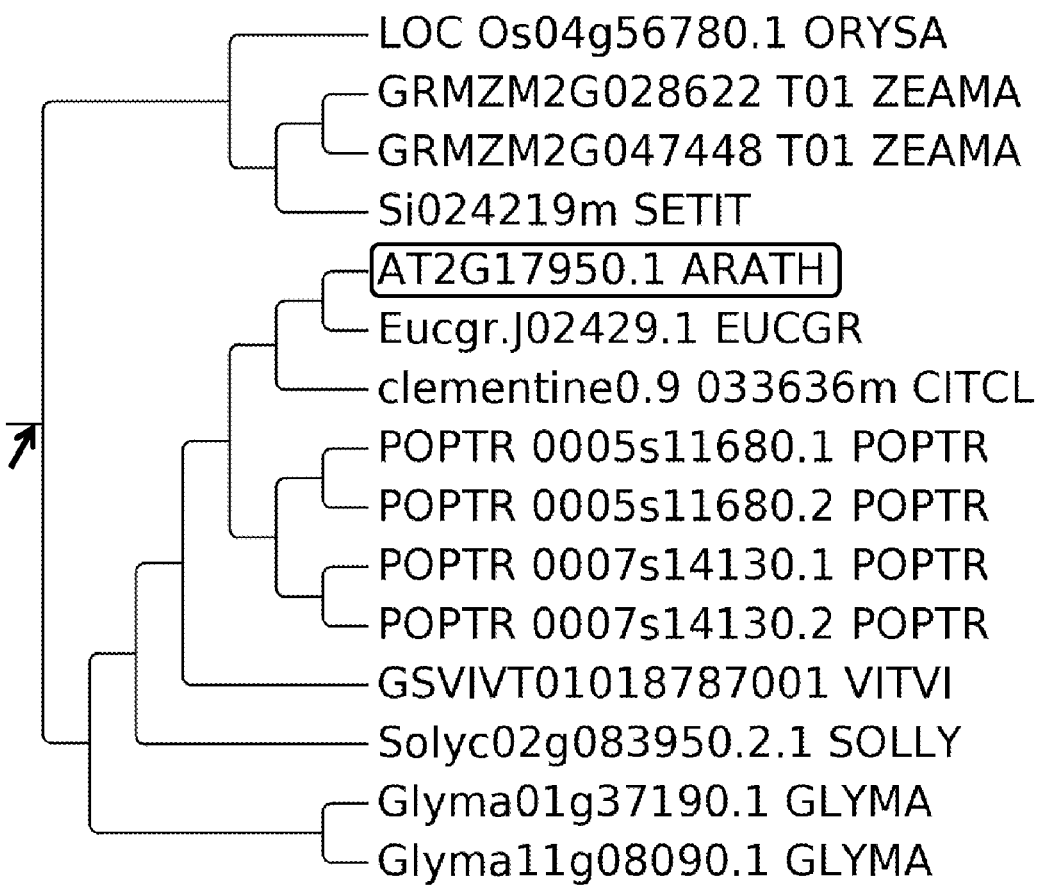

FIG. 12: a phylogenetic tree of AT2G17950 or "WUSCHEL" (also referred to as "WUS" or G1540) clade members and related full length proteins. WUS clade members are considered those proteins that descended from an ancestral sequence shown by the arrow, including the exemplary sequences shown in this figure that are bounded by LOC_Os04g56780.1 and Glyma11g08090.1.

FIGS. 13A-13K show an alignment of WUSCHEL (AT2G17950; "WUS") and representative clade-related proteins. The conserved homeodomains appear in the boxes in FIGS. 13B and 13C. The consensus sequence derived from the listed conserved domains is presented as SEQ ID NO: 516.

Figure 14:
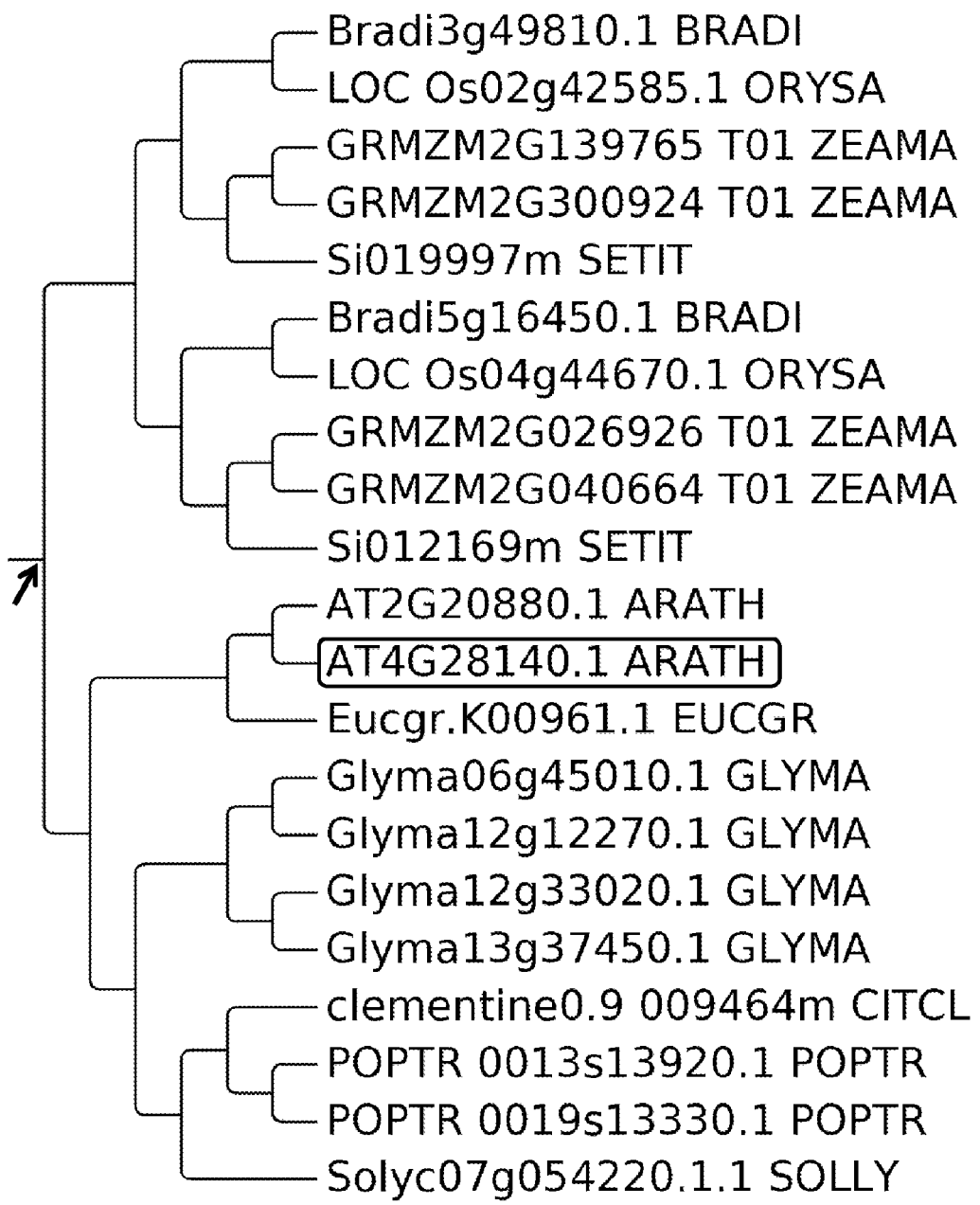

FIG. 14: a phylogenetic tree of AT4G28140 or "ERF054" (also referred to as "G1845) clade members and related full length proteins. ERF054 clade members are considered those proteins that descended from an ancestral sequence shown by the arrow, including the exemplary sequences shown in this figure that are bounded by Bradi3g49810.1 and Solyc07g054220.1.1.

FIGS. 15A-15O show an alignment of Ethylene-Responsive Factor ERF054 (AT4G28140; "ERF054) and representative clade-related proteins. The conserved AP2 domains appear in the boxes in FIGS. 15H and 15I. The consensus sequence derived from the listed conserved domains is presented as SEQ ID NO: 517.

Figure 16:
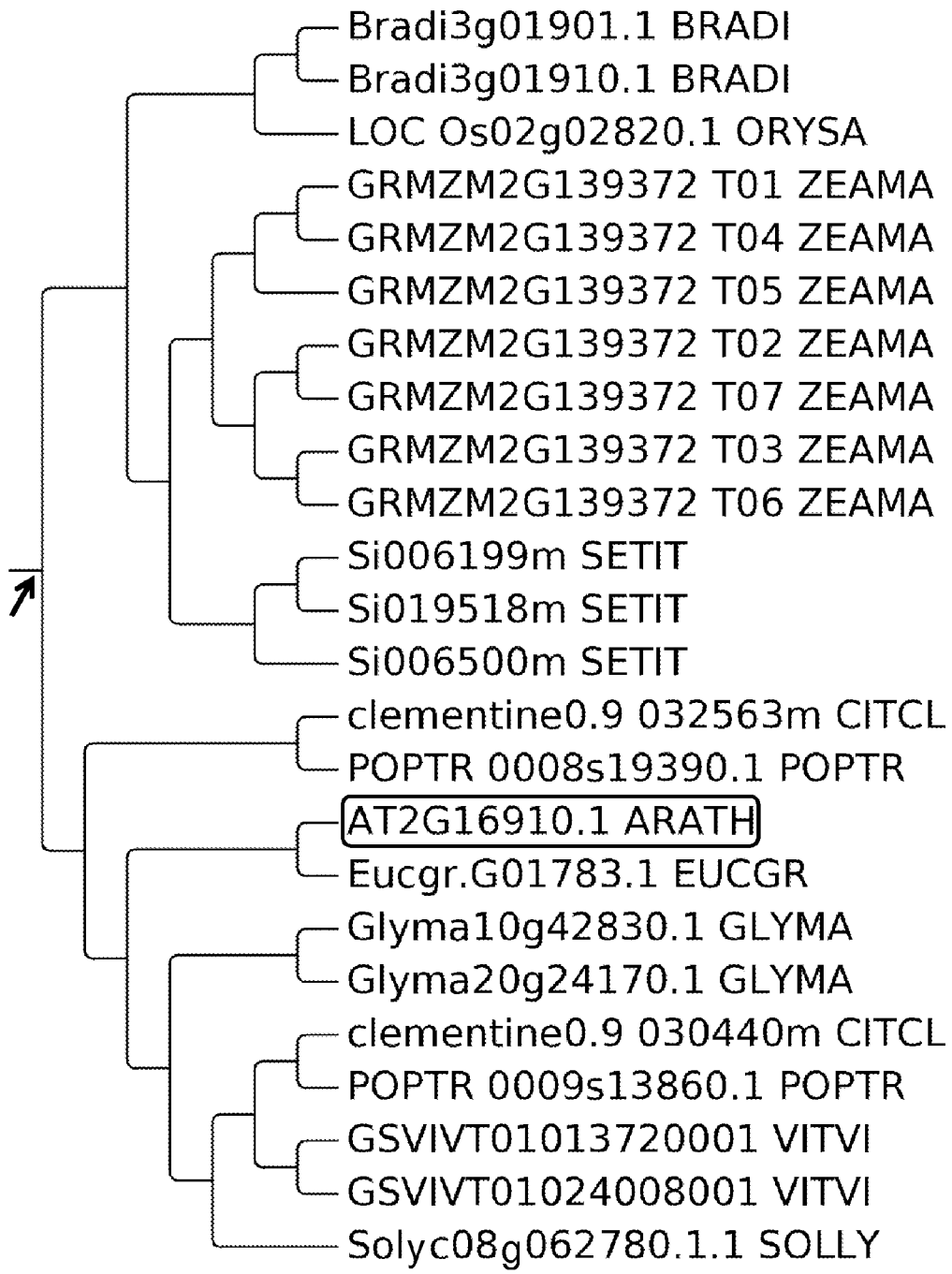

In FIG. 16: a phylogenetic tree of AT2G16910 or "AtbHLH021" (also referred to as "G1135") clade members and related full length proteins. AtbHLH021 clade members are considered those proteins that descended from an ancestral sequence shown by the arrow, including the exemplary sequences shown in this figure that are bounded by Bradi3g01901.1 and Solyc08g062780.1.1.

FIGS. 17A-17T show an alignment of ABORTED MICROSPORES (AT2G16910; "AMS" or "AtbHLH021") and representative clade-related proteins. The conserved bHLH domains appear in the boxes in FIG. 17L and continue through FIG. 17N. The consensus sequence derived from the listed conserved domains is presented as SEQ ID NO: 518.

Figure 18:
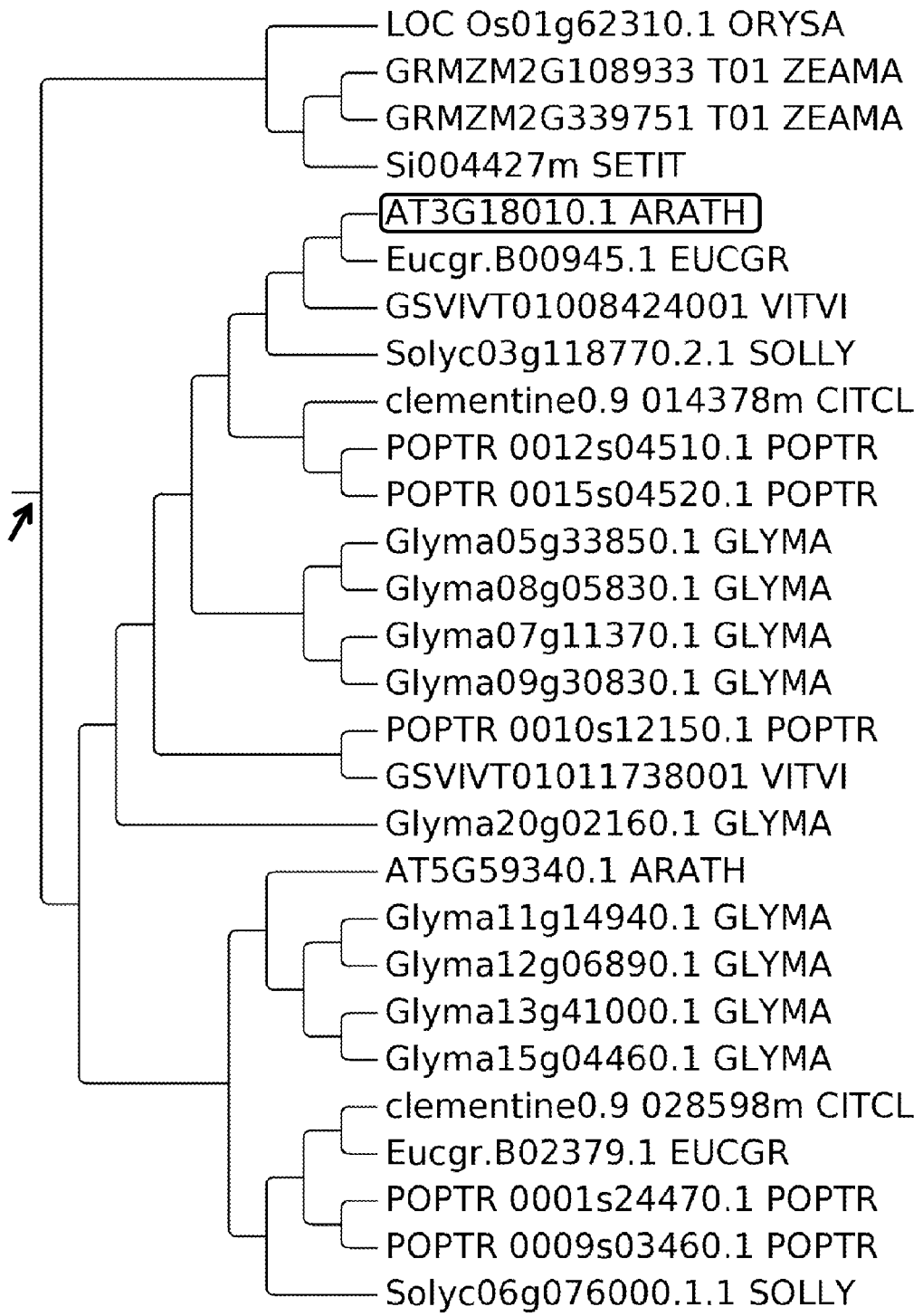

FIG. 18: a phylogenetic tree of AT3G18010 or "WOX1" (also referred to as "G539) clade members and related full length proteins. WOX1 clade members are considered those proteins that descended from an ancestral sequence shown by the arrow, including the exemplary sequences shown in this figure that are bounded by LOC_Os01g62310.1 and Solyc06g076000.1.1.

FIGS. 19A-19M show an alignment of WUSCHEL RELATED HOMEOBOX 1 (AT3G18010; "WOX1") and representative clade-related proteins. The conserved homeodomains appear in the boxes in FIG. 19C and continue through FIG. 19E. The consensus sequence derived from the listed conserved domains is presented as SEQ ID NO: 519.

DETAILED DESCRIPTION

The present description relates to polynucleotides and polypeptides for modifying phenotypes of plants, particularly those associated with increased photosynthetic resource use efficiency and increased yield with respect to a control plant. Throughout this disclosure, various information sources are referred to and/or are specifically incorporated. The information sources include scientific journal articles, patent documents, textbooks, and internet entries. While the reference to these information sources clearly indicates that they can be used by one of skill in the art, each and every one of the information sources cited herein are specifically incorporated in their entirety, whether or not a specific mention of "incorporation by reference" is noted. The contents and teachings of each and every one of the information sources can be relied on and used to make and use embodiments of the instant description.

As used herein and in the appended claims, the singular forms "a", "an", and "the" include the plural reference unless the context clearly dictates otherwise. Thus, for example, a reference to "a host cell" includes a plurality of such host cells, and a reference to "a plant" is a reference to one or more plants, and so forth.

A "recombinant polynucleotide" is a polynucleotide that is not in its native state, e.g., the polynucleotide comprises a nucleotide sequence not found in nature, or the polynucleotide is in a context other than that in which it is naturally found, e.g., separated from nucleotide sequences with which it typically is in proximity in nature, or adjacent (or contiguous with) nucleotide sequences with which it typically is not in proximity. For example, the sequence at issue can be cloned into a vector, or otherwise recombined with one or more additional nucleic acid.

A "polypeptide" is an amino acid sequence comprising a plurality of consecutive polymerized amino acid residues e.g., at least about 15 consecutive polymerized amino acid residues. In many instances, a polypeptide comprises a polymerized amino acid residue sequence that is a regulatory polypeptide or a domain or portion or fragment thereof. Additionally, the polypeptide may comprise: (i) a localization domain; (ii) an activation domain; (iii) a repression domain; (iv) an oligomerization domain; (v) a protein-protein interaction domain; (vi) a DNA-binding domain; or the like. The polypeptide optionally comprises modified amino acid residues, naturally occurring amino acid residues not encoded by a codon, or non-naturally occurring amino acid residues.

"Protein" refers to an amino acid sequence, oligopeptide, peptide, polypeptide or portions thereof whether naturally occurring or synthetic.

In the instant description, "exogenous" refers to a heterologous nucleic acid or polypeptide that may not be naturally expressed in a plant of interest. Exogenous nucleic acids may be introduced into a plant in a stable or transient manner via, for example, transformation or breeding, and may thus serve to produce in planta a homologous RNA molecule and an encoded and functional polypeptide. Exogenous nucleic acids and polypeptides introduced thusly may comprise sequences that are wholly or partially identical or homologous to sequences that naturally occur in (i.e., are endogenous with respect to) the plant.

A "recombinant polypeptide" is a polypeptide produced by translation of a recombinant polynucleotide. A "synthetic polypeptide" is a polypeptide created by consecutive polymerization of isolated amino acid residues using methods well known in the art. An "isolated polypeptide," whether a naturally occurring or a recombinant polypeptide, is more enriched in (or out of) a cell than the polypeptide in its natural state in a wild-type cell, e.g., more than about 5% enriched, more than about 10% enriched, or more than about 20%, or more than about 50%, or more, enriched, i.e., alternatively denoted: 105%, 110%, 120%, 150% or more, enriched relative to wild type standardized at 100%. Such an enrichment is not the result of a natural response of a wild-type plant. Alternatively, or additionally, the isolated polypeptide is separated from other cellular components with which it is typically associated, e.g., by any of the various protein purification methods herein.

"Identity" or "similarity" refers to sequence similarity between two polynucleotide sequences or between two polypeptide sequences, with identity being a more strict comparison. The phrases "percent identity" and "% identity" refer to the percentage of sequence similarity found in a comparison of two or more polynucleotide sequences or two or more polypeptide sequences. "Sequence similarity" refers to the percent similarity in base pair sequence (as determined by any suitable method) between two or more polynucleotide sequences. Two or more sequences can be anywhere from 0-100% similar or identical, or any integer value between 0-100%. Identity or similarity can be determined by comparing a position in each sequence that may be aligned for purposes of comparison. When a position in the compared sequence is occupied by the same nucleotide base or amino acid, then the molecules are identical at that position. A degree of similarity or identity between polyBLAST nucleotide sequences is a function of the number of identical, matching or corresponding nucleotides at positions shared by the polynucleotide sequences. A degree of identity of polypeptide sequences is a function of the number of identical amino acids at corresponding positions shared by the polypeptide sequences. A degree of homology or similarity of polypeptide sequences is a function of the number of amino acids at corresponding positions shared by the polypeptide sequences. The fraction or percentage of components in common is related to the homology or identity between the sequences. Alignments such as those of FIG. 2A-2J may be used to identify conserved domains and relatedness within these domains. An alignment may suitably be determined by means of computer programs known in the art, such as MACVECTOR software, (1999; Accelrys, Inc., San Diego, Calif.).

"Homologous sequences" refers to polynucleotide or polypeptide sequences that are similar due to common ancestry and sequence conservation. The terms "ortholog" and "paralog" are defined below in the section entitled "Orthologs and Paralogs". In brief, orthologs and paralogs are evolutionarily related genes that have similar sequences and functions. Orthologs are structurally related genes in different species that are derived by a speciation event. Paralogs are structurally related genes within a single species that are derived by a duplication event.

"Functional homologs" are polynucleotide or polypeptide sequences, including orthologs and paralogs, that are similar due to common ancestry and sequence conservation and have identical or similar function at the catalytic, cellular, or organismal levels. The presently disclosed polypeptides, clade members and phylogenetically related sequences are "functionally-related and/or closely-related" by having descended from common ancestral sequences, and/or by being sufficiently similar to the sequences and domains listed in the instant Tables and Sequence Listing that they confer the same function to plants of increased photosynthetic resource use efficiency, increased yield, increased grain yield, increased light use efficiency, increased photosynthetic capacity, increased photosynthetic rate, greater vigor, and/or greater biomass as compared to a control plant.

Functionally-related and/or closely-related polypeptides may be created artificially, semi-synthetically, or may occur naturally by having descended from the same ancestral sequence as the disclosed closely-related sequences, where the polypeptides have the function of conferring increased photosynthetic resource use efficiency to plants.

"Conserved domains" are recurring units in molecular evolution, the extents of which can be determined by sequence and structure analysis. A "conserved domain" or "conserved region" as used herein refers to a region in heterologous polynucleotide or polypeptide sequences where there is a relatively high degree of sequence identity between the distinct sequences. Conserved domains contain conserved sequence patterns or motifs that allow for their detection in, and identification and characterization of, polypeptide sequences. An AP2 domain, a basic Helix-Loop-Helix (bHLH) domain, a CBF/NF-Y domain, a Zinc Finger (ZF) DNA binding domain (e.g. a GATA-Zn domain, also referred to as a GATA-ZF domain), and a homeodomain DNA binding domain are examples of conserved domains.

A transgenic plant is expected to have improved or increased photosynthetic resource use efficiency relative to a control plant when the transgenic plant is transformed with a recombinant polynucleotide encoding any of the listed polypeptide sequences or polypeptide found in polypeptide clade of any of the listed polypeptide sequences, or when the transgenic plant contains or expresses a listed polypeptide or a member of any of the same polypeptide clades sequence in which the listed polypeptides may be found.

The terms "highly stringent" or "highly stringent condition" refer to conditions that permit hybridization of DNA strands whose sequences are highly complementary, wherein these same conditions exclude hybridization of significantly mismatched DNAs. Polynucleotide sequences capable of hybridizing under stringent conditions with the polynucleotides of the present description may be, for example, variants of the disclosed polynucleotide sequences, including allelic or splice variants, or sequences that encode orthologs or paralogs of presently disclosed polypeptides. Nucleic acid hybridization methods are disclosed in detail by Kashima et al., 1985. *Nature* 313: 402-404; Sambrook et al., 1989. *Molecular Cloning: A Laboratory Manual,* 2nd Ed., Cold Spring Harbor Laboratory, Cold Spring Harbor, N.Y., and by Haymes et al., 1985. *Nucleic Acid Hybridization: A Practical Approach*, IRL Press, Washington, D.C., which references are incorporated herein by reference.

In general, stringency is determined by the temperature, ionic strength, and concentration of denaturing agents (e.g., formamide) used in a hybridization and washing procedure (for a more detailed description of establishing and determining stringency, see the section "Identifying Polynucleotides or Nucleic Acids by Hybridization", below). The degree to which two nucleic acids hybridize under various conditions of stringency is correlated with the extent of their similarity. Thus, similar nucleic acid sequences from a variety of sources, such as within a plant's genome (as in the case of paralogs) or from another plant (as in the case of orthologs) that may perform similar functions can be isolated on the basis of their ability to hybridize with known related polynucleotide sequences. Numerous variations are possible in the conditions and means by which nucleic acid hybridization can be performed to isolate related polynucleotide sequences having similarity to sequences known in the art and are not limited to those explicitly disclosed herein. Such an approach may be used to isolate polynucleotide sequences having various degrees of similarity with disclosed polynucleotide sequences, such as, for example, encoded regulatory polypeptides listed in the Sequence Listing, or polypeptides that are phylogenetically related to the polypeptides listed in the Sequence Listing.

"Fragment", with respect to a polynucleotide, refers to a clone or any part of a polynucleotide molecule that retains a usable, functional characteristic. Useful fragments include oligonucleotides and polynucleotides that may be used in hybridization or amplification technologies or in the regulation of replication, transcription or translation. A "polynucleotide fragment" refers to any subsequence of a polynucleotide, typically, of at least about nine consecutive nucleotides, preferably at least about 30 nucleotides, more preferably at least about 50 nucleotides, of any of the sequences provided herein. Exemplary polynucleotide fragments are the first sixty consecutive nucleotides of the polynucleotides listed in the Sequence Listing. Exemplary fragments also include fragments that comprise a region that encodes an conserved domain of a polypeptide. Exemplary fragments also include fragments that comprise a conserved domain of a polypeptide. Exemplary fragments include fragments that comprise an conserved domain of a polypeptide, for example, any of the domains listed in in the instant Tables or in the Sequence Listing.

Fragments may also include subsequences of polypeptides and protein molecules, or a subsequence of the polypeptide. Fragments may have uses in that they may have antigenic potential. In some cases, the fragment or domain is a subsequence of the polypeptide which performs at least one biological function of the intact polypeptide in substantially the same manner, or to a similar extent, as does the intact polypeptide. For example, a polypeptide fragment can comprise a recognizable structural motif or functional domain such as a DNA-binding site or domain that binds to a DNA promoter region, an activation domain, or a domain for protein-protein interactions, and may initiate transcription. Fragments can vary in size from as few as three amino acid residues to the full length of the intact polypeptide, but are preferably at least about 30 amino acid residues in length and more preferably at least about 60 amino acid residues in length.

Fragments may also refer to a functional fragment of a promoter region. For example, a recombinant polynucleotide capable of modulating transcription in a plant may comprise a nucleic acid sequence with similarity to, or a percentage identity to, a promoter region exemplified by a promoter sequence provided in the Sequence Listing (also see promoters listed in Example II), a fragment thereof, or a complement thereof, wherein the nucleic acid sequence, or the fragment thereof, or the complement thereof, regulates expression of a polypeptide in a plant cell.

The term "plant" includes whole plants, shoot vegetative organs/structures (for example, leaves, stems and tubers), roots, flowers and floral organs/structures (for example, bracts, sepals, petals, stamens, carpels, anthers and ovules), seed (including embryo, endosperm, and seed coat) and fruit (the mature ovary), plant tissue (for example, vascular tissue, ground tissue, and the like), pulped, pureed, ground-up, macerated or broken-up tissue, and cells (for example, guard cells, egg cells, and the like), and progeny of same. The class of the plants that can be transformed using the methods provided of the instant description is generally as broad as the class of higher and lower plants amenable to transformation techniques, including angiosperms (monocotyledonous and dicotyledonous plants), gymnosperms, ferns, horsetails, psilophytes, lycophytes, and bryophytes. These plant parts, organs, structures, cells, tissue, or progeny may contain a recombinant polynucleotide of interest, such as one that comprises a described or listed polynucleotide or one that encodes a described or listed polypeptide or a polypeptide that is phylogenetically-related to a listed polypeptide, and is thus a member of the same polypeptide clade.

A "control plant" as used in the present description refers to a plant cell, seed, plant component, plant tissue, plant organ or whole plant used to compare against transgenic or genetically modified plant for the purpose of identifying an enhanced phenotype in the transgenic or genetically modified plant. A control plant may in some cases be a transgenic plant line that comprises an empty vector or marker gene, but does not contain the recombinant polynucleotide of the present description that is expressed in the transgenic or genetically modified plant being evaluated. In general, a control plant is a plant of the same line or variety as the transgenic or genetically modified plant being tested. A suitable control plant would include a genetically unaltered or non-transgenic plant of the parental line used to generate a transgenic plant herein.

A "transgenic plant" refers to a plant that contains genetic material not found in a wild-type plant of the same species, variety or cultivar. The genetic material may include a transgene, an insertional mutagenesis event (such as by transposon or T-DNA insertional mutagenesis), an activation tagging sequence, a mutated sequence, a homologous recombination event or a sequence modified by chimeraplasty. Typically, the foreign genetic material has been introduced into the plant by human manipulation, but any method can be used as one of skill in the art recognizes.

A transgenic line or transgenic plant line refers to the progeny plant or plants deriving from the stable integration of heterologous genetic material into a specific location or locations within the genome of the original transformed cell.

A transgenic plant may contain an expression vector or cassette. The expression vector or cassette typically comprises a polypeptide-encoding sequence operably linked (i.e., under regulatory control of) to appropriate inducible, tissue-enhanced, tissue-specific, or constitutive regulatory sequences that allow for the controlled expression of the polypeptide. The expression vector or cassette can be introduced into a plant by transformation or by breeding after transformation of a parent plant. A plant refers to a whole plant as well as to a plant part, such as seed, fruit, leaf, or root, plant tissue, plant cells or any other plant material, e.g., a plant explant, as well as to progeny thereof, and to in vitro systems that mimic biochemical or cellular components or processes in a cell. In some other embodiments, the expression vectors or cassettes do not occur naturally. In some embodiments, the expression vectors or cassettes comprise a promoter of the present application, and a gene of interest, wherein the promoter and the gene of interest do not link to each other under natural conditions, e.g., the linkage between the promoter and the gene of interest does not exist in nature. For example, in some embodiments, the promoter and the gene of interest are derived from a same plant species, but are not linked to each other under natural conditions. In some embodiments, the promoter and the gene of interest are derived from two different species, e.g., the promoter and the gene of interest are heterologous to each other. In some embodiments, the gene of interest is derived from a different plant species, a bacteria species, a fungal species, a viral species, an algae species, or an animal species. In some embodiments, the expression vectors or cassettes comprise synthetic sequences.

"Germplasm" refers to a genetic material or a collection of genetic resources for an organism from an individual plant, a group of related individual plants (for example, a plant line, a plant variety or a plant family), or a clone derived from a plant line, plant variety, plant species, or plant culture.

A constitutive promoter is active under most environmental conditions, and in most plant parts. Regulation of protein expression in a constitutive manner refers to the control of expression of a gene and/or its encoded protein in all tissues regardless of the surrounding environment or development stage of the plant.

Alternatively, expression of the disclosed or listed polypeptides may be under the regulatory control of a promoter that is not a constitutive promoter. For example, tissue-enhanced (also referred to as tissue-preferred), tissue-specific, cell type-specific, and inducible promoters constitute non-constitutive promoters; that is, these promoters do not regulate protein expression in a constitutive manner. Tissue-enhanced or tissue-preferred promoters facilitate expression of a gene and/or its encoded protein in specific tissue(s) and generally, although perhaps not completely, do not express the gene and/or protein in all other tissues of the plant, or do so to a much lesser extent. Promoters under developmental control include promoters that preferentially initiate transcription in certain tissues, such as xylem, leaves, roots, or seeds. Such promoters are examples of tissue-enhanced or tissue-preferred promoters (see U.S. Pat. No. 7,365,186). Tissue-specific promoters generally confine transgene expression to a single plant part, tissue or cell-type, although many such promoters are not perfectly restricted in their expression and their regulatory control is more properly described as being "tissue-enhanced" or "tissue-preferred". Tissue-enhanced promoters primarily regulate transgene expression in a limited number of plant parts, tissues or cell-types and cause the expression of proteins to be overwhelming restricted to a few particular tissues, plant parts, or cell types. An example of a tissue-enhanced promoter is a "photosynthetic tissue-enhanced promoter", for which the promoter preferentially regulates gene or protein expression in photosynthetic tissues (e.g., leaves, cotyledons, stems, etc.). Tissue-enhanced promoters can be found upstream and operatively linked to DNA sequences normally transcribed in higher levels in certain plant tissues or specifically in certain plant tissues, respectively. "Cell-enhanced", "tissue-enhanced", or "tissue-specific" regulation thus refer to the control of gene or protein expression, for example, by a promoter that drives expression that is not necessarily totally restricted to a single type of cell or tissue, but where expression is elevated in particular cells or tissues to a greater extent than in other cells or tissues within the organism, and in the case of tissue-specific regulation, in a manner that is primarily elevated in a specific tissue. Tissue-enhanced or preferred promoters have been described in, for example, U.S. Pat. No. 7,365,186, or U.S. Pat. No. 7,619, 133.

Another example of a promoter that is not a constitutive promoter is a "condition-enhanced" promoter, the latter term referring to a promoter that activates a gene in response to a particular environmental stimulus. This may include, for example, an abiotic stress, infection caused by a pathogen, light treatment, etc., and a condition-enhanced promoter drives expression in a unique pattern which may include expression in specific cell and/or tissue types within the organism (as opposed to a constitutive expression pattern in all cell types of an organism at all times).

"Wild type" or "wild-type", as used herein, refers to a plant cell, seed, plant component, plant tissue, plant organ or whole plant that has not been genetically modified or treated in an experimental sense. Wild-type cells, seed, components, tissue, organs or whole plants may be used as controls to compare levels of expression and the extent and nature of trait modification with cells, tissue or plants of the same species in which a polypeptide's expression is altered, e.g., in that it has been knocked out, overexpressed, or ectopically expressed.

When two or more plants have "similar morphologies", "substantially similar morphologies", "a morphology that is substantially similar", or are "morphologically similar", the plants have comparable forms or appearances, including analogous features such as overall dimensions, height, width, mass, root mass, shape, glossiness, color, stem diameter, leaf size, leaf dimension, leaf density, internode distance, branching, root branching, number and form of inflorescences, and other macroscopic characteristics at a particular stage of growth. It may be difficult to distinguish two plants that are genotypically distinct but morphologically similar based on morphological characteristics alone. If the plants are morphologically similar at all stages of growth, they are also "developmentally similar".

With regard to gene knockouts as used herein, the term "knockout" (KO) refers to a plant or plant cell having a disruption in at least one gene in the plant or cell, where the disruption results in a reduced expression or activity of the polypeptide encoded by that gene compared to a control cell. The knockout can be the result of, for example, genomic disruptions, including transposons, tilling, and homologous recombination, antisense constructs, sense constructs, RNA silencing constructs, or RNA interference. A T-DNA insertion within a gene is an example of a genotypic alteration that may abolish expression of that gene. "Ectopic expression" or "altered expression" in reference to a polynucleotide indicates that the pattern of expression in, e.g., a transgenic plant or plant tissue, is different from the expression pattern in a wild-type plant or a reference plant of the same species. The pattern of expression may also be compared with a reference expression pattern in a wild-type plant of the same species. For example, the polynucleotide or polypeptide is expressed in a cell or tissue type other than a cell or tissue type in which the sequence is expressed in the wild-type plant, or by expression at a time other than at the time the sequence is expressed in the wild-type plant, or by a response to different inducible agents, such as hormones or environmental signals, or at different expression levels (either higher or lower) compared with those found in a wild-type plant. The term also refers to altered expression patterns that are produced by lowering the levels of expression to below the detection level or completely abolishing expression. The resulting expression pattern can be transient or stable, constitutive or inducible. In reference to a polypeptide, the term "ectopic expression or altered expression" further may relate to altered activity levels resulting from the interactions of the polypeptides with exogenous or endogenous modulators or from interactions with factors or as a result of the chemical modification of the polypeptides.

The term "overexpression" as used herein refers to a greater expression level of a gene in a plant, plant cell or plant tissue, compared to expression of that gene in a wild-type plant, cell or tissue, at any developmental or temporal stage. Overexpression can occur when, for example, the genes encoding one or more polypeptides are under the control of a strong promoter (e.g., the cauliflower mosaic virus 35S transcription initiation region). Overexpression may also be achieved by placing a gene of interest under the control of an inducible or tissue specific promoter, or may be achieved through integration of transposons or engineered T-DNA molecules into regulatory regions of a target gene. Other means for inducing overexpression may include making targeted changes in a gene's native promoter, e.g. through elimination of negative regulatory sequences or engineering positive regulatory sequences, though the use of targeted nuclease activity (such as zinc finger nucleases or TAL effector nucleases) for genome editing. Elimination of micro-RNA binding sites in a gene's transcript may also result in overexpression of that gene. Additionally, a gene may be overexpressed by creating an artificial transcriptional activator targeted to bind specifically to its promoter sequences, comprising an engineered sequence-specific DNA binding domain such as a zinc finger protein or TAL effector protein fused to a transcriptional activation domain. Thus, overexpression may occur throughout a plant, in specific tissues of the plant, or in the presence or absence of particular environmental signals, depending on the promoter or overexpression approach used.

Overexpression may take place in plant cells normally lacking expression of polypeptides functionally equivalent or identical to the present polypeptides. Overexpression may also occur in plant cells where endogenous expression of the present polypeptides or functionally equivalent molecules normally occurs, but such normal expression is at a lower level. Overexpression thus results in a greater than normal production, or "overproduction" of the polypeptide in the plant, cell or tissue. "Photosynthetic resource-use efficiency" is defined as the rate of photosynthesis achieved per unit use of a given resource. Consequently, increases in photosynthesis relative to the use of a given resource will improve photosynthetic resource-use efficiency. Photosynthesis is constrained by the availability of various resources, including light, water and nitrogen. Improving the efficiency with which photosynthesis makes use of light, water and nitrogen is a means for increasing plant productivity, crop growth, and yield. For the purposes of comparing a plant of interest to a reference or control plant, the ratio of photosynthesis to use of a given resource is often determined for a fixed unit of leaf area. Examples of increased photosynthetic resource-use efficiency would be an increase in the ratio of the rate of photosynthesis for a given leaf relative to, for example, the rate of transpiration from the same leaf area, nitrogen or chlorophyll invested in that leaf area, or light absorbed by that same leaf area. Increased photosynthetic resource use efficiency may result from increased photosynthetic rate, photosynthetic capacity, a decrease in leaf chlorophyll content, a decrease in percentage of nitrogen in leaf dry weight, increased transpiration efficiency, an increase in resistance to water vapor diffusion exerted by leaf stomata, an increased rate of relaxation of photoprotective reactions operating in the light harvesting antennae, a decrease in the ratio of the carbon isotope $^{12}C$ to $^{13}C$ in above-ground biomass, and/or an increase in the total dry weight of above-ground plant material. Photosynthetic resource use efficiency may also be improved over longer time scales, for example the entire life cycle of a crop, through traits that confer tolerance against regularly experienced severe abiotic stress, but that may compromise photosynthesis under stress free environmental conditions.

"Photosynthetic rate" refers to the rate of photosynthesis achieved by a leaf, and is typically expressed relative to a unit of leaf area. The photosynthetic rate at any given time results from the photosynthetic capacity of the leaf (see below) and the biotic or abiotic environmental constraints prevailing at that time. "Photosynthetic capacity" refers to the capacity for photosynthesis per unit leaf area and is set by the leaf's investment in the components of the photosynthetic apparatus. Key components, among many, would be the pigments and proteins required to regulate light absorption and transduction of light energy to the photosynthetic reaction centers, and the enzymes required to operate the C3 and C4 dark reactions of photosynthesis. Increasing photosynthetic capacity is seen as an important means of increasing leaf and crop-canopy photosynthesis, and crop yield.

"Rubisco (ribulose-1,5-bisphosphate carboxylase oxygenase) activity" refers to the activation state of Rubisco, the most abundant protein in the chloroplast and a key limitation to C3 photosynthesis. Increasing Rubisco activity by: increasing the amount of Rubisco in the chloroplast; impacting any combination of specific reactions that regulate Rubisco activity; or increasing the concentration of $CO_2$ in the chloroplast, is seen as an important means to improving C3 leaf and crop-canopy photosynthesis and crop yield.

The "capacity for RuBP (ribulose-1,5-bisphosphate) regeneration" refers to the rate at which RuBP, a key photosynthetic substrate is regenerated in the Calvin cycle. Increasing the capacity for RuBP regeneration by increasing the activity of enzymes in the regenerative phase of the Calvin cycle is seen as an important means to improving C3 leaf and crop-canopy photosynthesis and crop yield that will become progressively more important as atmospheric $CO_2$ concentrations continue to rise.

"Leaf chlorophyll content" refers to the chlorophyll content of the leaf expressed either per unit leaf area or unit weight. Sun leaves in the upper part of crop canopies are thought to have higher leaf chlorophyll content than is required for photosynthesis. The consequence is that these leaves: invest more nitrogen in chlorophyll than is required for photosynthesis; are prone to photodamage associated with absorbing more light energy than can be dissipated via photosynthesis; and impair the transmission of light into the leaf and lower canopy where photosynthesis is light limited. Consequently, decreasing leaf chlorophyll content of upper canopy leaves is considered an effective means to improving photosynthetic resource-use efficiency.

"Non-photochemical quenching" is a term that covers photoprotective processes that dissipate absorbed light energy as heat from the light-harvesting antenna of photosystem II. Non-photochemical quenching is a key regulator of the efficiency with which electron transport is initiated by PSII and the efficiency of photosynthesis at low light. Decreasing the level of non-photochemical quenching, or increasing the speed with which it relaxes is expected to confer cumulative gains in photosynthesis every time the light intensity to which the canopy is exposed transitions from high to low, and is considered a means to improving canopy photosynthesis when integrated over a growing season.

"Water use efficiency", or WUE, measured as the biomass produced per unit transpiration, describes the relationship between water use and crop production. The basic physiological definition of WUE equates to the ratio of photosynthesis (A) to transpiration (T), also referred to as transpiration efficiency (Karaba et al. 2007, supra; Morison et al., 2008, supra).

"Stomatal conductance" refers to a measurement of the limitation that the stomatal pore imposes on $CO_2$ diffusion into, and $H_2O$ diffusion out of, the leaf. Decreasing stomatal conductance will decrease water loss from the leaf and crop canopy via transpiration. This will conserve soil water, delay the onset and reduce the severity of drought effects on canopy photosynthesis and other physiology. Decreasing stomatal conductance will also decrease photosynthesis. However, the magnitude of the decrease in photosynthesis will typically be less than the decrease in transpiration, and transpiration efficiency will increase as a result. Conversely, increasing stomatal conductance can increase the diffusion of $CO_2$ into the leaf and increase photosynthesis in a C3 leaf. Typically, transpiration will increase to a greater extent than photosynthesis, and transpiration efficiency will therefore decrease.

"Yield" or "plant yield" refers to increased plant growth, increased crop growth, increased biomass, and/or increased plant product production (including grain), and is dependent to some extent on temperature, plant size, organ size, planting density, light, water and nutrient availability, and how the plant copes with various stresses, such as through temperature acclimation and water or nutrient use efficiency. For grain crops, yield generally refers to an amount of grain produced or harvested per unit of land area, such as bushels or tons per acre or tonnes per hectare. Increased or improved yield may be measured as increased seed yield, increased plant product yield (plant products include, for example, plant tissue, including ground or otherwise broken-up plant tissue, and products derived from one or more types of plant tissue), or increased vegetative yield.

DESCRIPTION OF THE SPECIFIC EMBODIMENTS

Regulatory Polypeptides Modify Expression of Endogenous Genes.

A regulatory polypeptide may include, but is not limited to, any polypeptide that can activate or repress transcription of a single gene or a number of genes. As one of ordinary skill in the art recognizes, regulatory polypeptides can be identified by the presence of a region or domain of structural similarity or identity to a specific consensus sequence or the presence of a specific consensus DNA-binding motif (see, for example, Riechmann et al., 2000a. supra).

Generally, regulatory polypeptides control the manner in which information encoded by genes is used to produce gene products and control various pathways, and may be involved in diverse processes including, but not limited to, cell differentiation, proliferation, morphogenesis, and the regulation of growth or environmental responses. Accordingly, one skilled in the art would recognize that by expressing the present sequences in a plant, one may change the expression of autologous genes or induce the expression of introduced genes. By affecting the expression of similar autologous sequences in a plant that have the biological activity of the present sequences, or by introducing the present sequences into a plant, one may alter a plant's phenotype to one with improved traits related to photosynthetic resource use efficiency. The sequences of the instant description may also be used to transform a plant and introduce desirable traits not found in the wild-type cultivar or strain. Plants may then be selected for those that produce the most desirable degree of over- or under-expression of target genes of interest and coincident trait improvement.

The sequences of the present description may be from any species, particularly plant species, in a naturally occurring form or from any source whether natural, synthetic, semi-synthetic or recombinant. The sequences of the instant description may also include fragments of the present amino acid sequences. Where "amino acid sequence" is recited to refer to an amino acid sequence of a naturally occurring protein molecule, "amino acid sequence" and like terms are not meant to limit the amino acid sequence to the complete native amino acid sequence associated with the recited protein molecule.

In addition to methods for modifying a plant phenotype by employing one or more polynucleotides and polypeptides of the instant description described herein, the polynucleotides and polypeptides of the instant description have a variety of additional uses. These uses include their use in the recombinant production (i.e., expression) of proteins; as regulators of plant gene expression, as diagnostic probes for the presence of complementary or partially complementary nucleic acids (including for detection of natural coding nucleic acids); as substrates for further reactions, e.g., mutation reactions, PCR reactions, or the like; as substrates for cloning e.g., including digestion or ligation reactions; and for identifying exogenous or endogenous modulators of the regulatory polypeptides. The polynucleotide can be, e.g., genomic DNA or RNA, a transcript (such as an mRNA), a cDNA, a PCR product, a cloned DNA, a synthetic DNA or RNA, or the like. The polynucleotide can comprise a sequence in either sense or antisense orientations.

Expression of genes that encode polypeptides that modify expression of endogenous genes, polynucleotides, and proteins are well known in the art. In addition, transgenic plants comprising polynucleotides encoding regulatory polypeptides may also modify expression of endogenous genes, polynucleotides, and proteins. Examples include Peng et al., 1997. *Genes Development* 11: 3194-3205, and Peng et al., 1999. *Nature* 400: 256-261. In addition, many others have demonstrated that an *Arabidopsis* regulatory polypeptide expressed in an exogenous plant species elicits the same or very similar phenotypic response. See, for example, Fu et al., 2001. *Plant Cell* 13: 1791-1802; Nandi et al., 2000. *Curr. Biol.* 10: 215-218; Coupland, 1995. *Nature* 377: 482-483; and Weigel and Nilsson, 1995. *Nature* 377: 482-500.

In another example, Mandel et al., 1992b. *Cell* 71-133-143, and Suzuki et al., 2001. *Plant J.* 28: 409-418, teach that a transcription factor expressed in another plant species elicits the same or very similar phenotypic response of the endogenous sequence, as often predicted in earlier studies of *Arabidopsis* transcription factors in *Arabidopsis* (see Mandel et al., 1992a. *Nature* 360: 273-277; Suzuki et al., 2001. supra). Other examples include Müller et al., 2001. *Plant J.* 28: 169-179; Kim et al., 2001. *Plant J.* 25: 247-259; Kyozuka and Shimamoto, 2002. *Plant Cell Physiol.* 43: 130-135; Boss and Thomas, 2002. *Nature,* 416: 847-850; He et al., 2000. *Transgenic Res.* 9: 223-227; and Robson et al., 2001. *Plant J.* 28: 619-631.

In yet another example, Gilmour et al., 1998. *Plant J.* 16: 433-442 teach an *Arabidopsis* AP2 transcription factor, CBF1, which, when overexpressed in transgenic plants, increases plant freezing tolerance. Jaglo et al., 2001. *Plant Physiol.* 127: 910-917, further identified sequences in *Brassica napus* which encode CBF-like genes and that transcripts for these genes accumulated rapidly in response to low temperature. Transcripts encoding CBF proteins were also found to accumulate rapidly in response to low temperature in wheat, as well as in tomato. An alignment of the CBF proteins from *Arabidopsis, B. napus*, wheat, rye, and tomato revealed the presence of conserved consecutive amino acid residues which bracket the AP2/EREBP DNA binding domains of the proteins and distinguish them from other members of the AP2/EREBP protein family (Jaglo et al., 2001. supra).

Regulatory polypeptides mediate cellular responses and control traits through altered expression of genes containing cis-acting nucleotide sequences that are targets of the introduced regulatory polypeptide. It is well appreciated in the art that the effect of a regulatory polypeptide on cellular responses or a cellular trait is determined by the particular genes whose expression is either directly or indirectly (e.g., by a cascade of regulatory polypeptide binding events and transcriptional changes) altered by regulatory polypeptide binding. In a global analysis of transcription comparing a standard condition with one in which a regulatory polypeptide is overexpressed, the resulting transcript profile associated with regulatory polypeptide overexpression is related to the trait or cellular process controlled by that regulatory polypeptide. For example, the PAP2 gene and other genes in the Myb family have been shown to control anthocyanin biosynthesis through regulation of the expression of genes known to be involved in the anthocyanin biosynthetic pathway (Bruce et al., 2000. *Plant Cell* 12: 65-79; and Borevitz et al., 2000. *Plant Cell* 12: 2383-2393). Further, global transcript profiles have been used successfully as diagnostic tools for specific cellular states (e.g., cancerous vs. noncancerous; Bhattacharjee et al., 2001. *Proc. Natl. Acad. Sci. USA* 98: 13790-13795; and Xu et al., 2001. *Proc. Natl. Acad. Sci. USA* 98: 15089-15094). Consequently, it is evident to one skilled in the art that similarity of transcript profile upon overexpression of different regulatory polypeptides would indicate similarity of regulatory polypeptide function.

Polypeptides and Polynucleotides of the Present Description.

The present description includes putative regulatory polypeptides, and isolated or recombinant polynucleotides encoding the polypeptides, or novel sequence variant polypeptides or polynucleotides encoding novel variants of polypeptides derived from the specific sequences provided in the Sequence Listing; the recombinant polynucleotides of the instant description may be incorporated in expression vectors for the purpose of producing transformed plants.

Because of their relatedness at the nucleotide level, the claimed sequences will typically share at least about 30% nucleotide sequence identity, or at least 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95% or 96%, 97%, 98%, 99%, or about 100% sequence identity to one or more of the listed full-length sequences, or to a listed sequence but excluding or outside of the region(s) encoding a known consensus sequence or consensus DNA-binding site, or outside of the region(s) encoding one or all conserved domains. The degeneracy of the genetic code enables major variations in the nucleotide sequence of a polynucleotide while maintaining the amino acid sequence of the encoded protein.

Because of their relatedness at the protein level, the claimed nucleotide sequences will typically encode a polypeptide that is at least 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95% or 96%, 97%, 98%, 99%, or about 100% identical in its amino acid sequence to the entire length of any of the polypeptides listed in the Sequence Listing or the instant Tables, or closely- or phylogenetically-related sequences.

Also provided are methods for modifying yield from a plant by modifying the mass, size or number of plant organs or seed of a plant by controlling a number of cellular processes, and for increasing a plant's photosynthetic resource use efficiency. These methods are based on the ability to alter the expression of critical regulatory molecules that may be conserved between diverse plant species. Related conserved regulatory molecules may be originally discovered in a model system such as *Arabidopsis* and homologous, functional molecules then discovered in other plant species. The latter may then be used to confer increased yield or photosynthetic resource use efficiency in diverse plant species.

Sequences in the Sequence Listing, derived from diverse plant species, may be ectopically expressed in overexpressor plants. The changes in the characteristic(s) or trait(s) of the plants may then be observed and found to confer increased yield and/or increased photosynthetic resource use efficiency. Therefore, the polynucleotides and polypeptides can be used to improve desirable characteristics of plants.

The polynucleotides of the instant description are also ectopically expressed in overexpressor plant cells and the changes in the expression levels of a number of genes, polynucleotides, and/or proteins of the plant cells observed. Therefore, the polynucleotides and polypeptides can be used to change expression levels of genes, polynucleotides, and/ or proteins of plants or plant cells.

The data presented herein represent the results obtained in experiments with polynucleotides and polypeptides that may be expressed in plants for the purpose of increasing yield that arises from improved photosynthetic resource use efficiency.

Variants of the Disclosed Sequences.

Also within the scope of the instant description is a variant of a nucleic acid listed in the Sequence Listing, that is, one having a sequence that differs from the one of the polynucleotide sequences in the Sequence Listing, or a complementary sequence, that encodes a functionally equivalent polypeptide (i.e., a polypeptide having some degree of equivalent or similar biological activity) but differs in sequence from the sequence in the Sequence Listing, due to degeneracy in the genetic code. Included within this definition are polymorphisms that may or may not be readily detectable using a particular oligonucleotide probe of the polynucleotide encoding polypeptide, and improper or unexpected hybridization to allelic variants, with a locus other than the normal chromosomal locus for the polynucleotide sequence encoding polypeptide.

Differences between presently disclosed polypeptides and polypeptide variants are limited so that the sequences of the former and the latter are closely similar overall and, in many regions, identical. Presently disclosed polypeptide sequences and similar polypeptide variants may differ in amino acid sequence by one or more substitutions, additions, deletions, fusions and truncations, which may be present in any combination. These differences may produce silent changes and result in a functionally equivalent polypeptides. Thus, it will be readily appreciated by those of skill in the art, that any of a variety of polynucleotide sequences is capable of encoding the polypeptides and homolog polypeptides of the instant description. A polypeptide sequence variant may have "conservative" changes, wherein a substituted amino acid has similar structural or chemical properties.

Conservative substitutions include substitutions in which at least one residue in the amino acid sequence has been removed and a different residue inserted in its place. Such substitutions generally are made in accordance with the Table 1 when it is desired to maintain the activity of the protein. Table 1 shows amino acids which can be substituted for an amino acid in a protein and which are typically regarded as conservative substitutions.

TABLE 1

Possible conservative amino acid substitutions

| Amino Acid Residue | Conservative substitutions |
|---|---|
| Ala | Ser |
| Arg | Lys |
| Asn | Gln; His |
| Asp | Glu |
| Gln | Asn |
| Cys | Ser |
| Glu | Asp |
| Gly | Pro |
| His | Asn; Gln |
| Ile | Leu, Val |
| Leu | Ile; Val |
| Lys | Arg; Gln |
| Met | Leu; Ile |
| Phe | Met; Leu; Tyr |
| Pro | Gly |
| Ser | Thr; Gly |
| Thr | Ser; Val |
| Trp | Tyr |
| Tyr | Trp; Phe |
| Val | Ile; Leu |

The polypeptides provided in the Sequence Listing have a novel activity, such as, for example, regulatory activity. Although all conservative amino acid substitutions (for example, one basic amino acid substituted for another basic amino acid) in a polypeptide will not necessarily result in the polypeptide retaining its activity, it is expected that many of these conservative mutations would result in the polypeptide retaining its activity. Most mutations, conservative or non-conservative, made to a protein but outside of a conserved domain required for function and protein activity will not affect the activity of the protein to any great extent.

Deliberate amino acid substitutions may thus be made on the basis of similarity in polarity, charge, solubility, hydrophobicity, hydrophilicity, and/or the amphipathic nature of the residues, as long as a significant amount of the functional or biological activity of the polypeptide is retained. For example, negatively charged amino acids may include aspartic acid and glutamic acid, positively charged amino acids may include lysine and arginine, and amino acids with uncharged polar head groups having similar hydrophilicity values may include leucine, isoleucine, and valine; glycine and alanine; asparagine and glutamine; serine and threonine; and phenylalanine and tyrosine. More rarely, a variant may have "non-conservative" changes, e.g., replacement of a glycine with a tryptophan Similar minor variations may also include amino acid deletions or insertions, or both. Related polypeptides may comprise, for example, additions and/or deletions of one or more N-linked or O-linked glycosylation sites, or an addition and/or a deletion of one or more cysteine residues. Guidance in determining which and how many amino acid residues may be substituted, inserted or deleted without abolishing functional or biological activity may be found using computer programs well known in the art, for example, DNASTAR software (see U.S. Pat. No. 5,840,544).

Conserved Domains.

Conserved domains are recurring functional and/or structural units of a protein sequence within a protein family (for example, a family of regulatory proteins), and distinct conserved domains have been used as building blocks in molecular evolution and recombined in various arrangements to make proteins of different protein families with different functions. Conserved domains often correspond to the 3-dimensional domains of proteins and contain conserved sequence patterns or motifs, which allow for their detection in polypeptide sequences with, for example, the use of a Conserved Domain Database (for example, at www.ncbi.nlm.nih.gov/cdd). The National Center for Biotechnology Information Conserved Domain Database defines conserved domains as recurring units in molecular evolution, the extents of which can be determined by sequence and structure analysis. Conserved domains contain conserved sequence patterns or motifs, which allow for their detection in polypeptide sequences (Conserved Domain Database; www.ncbi.nlm.nih.gov/Structure/cdd/cdd.shtml).

Conserved domains may also be identified as regions or domains of identity to a specific consensus sequence (see, for example, Riechmann et al., 2000a. *Science* 290, 2105-2110; Riechmann et al., 2000b. *Curr Opin Plant Biol* 3: 423-434). Thus, by using alignment methods well known in the art, the conserved domains of the plant polypeptides, for example, for the AP2 domain, basic Helix-Loop-Helix (bHLH) domain, CBF/NF-Y domain, Zinc Finger (ZF) DNA binding domain or homeodomain DNA binding domain polypeptides, may be determined. The polypeptides of the instant Tables have conserved domains associated with the disclosed functions of the proteins in which they are found and specifically indicated by amino acid coordinate start and stop sites. A comparison of the regions of these polypeptides allows one of skill in the art (see, for example, Reeves and Nissen, 1990. *J. Biol. Chem.* 265, 8573-8582; Reeves and Nissen, 1995. *Prog. Cell Cycle Res.* 1: 339-349) to identify domains or conserved domains for any of the polypeptides listed or referred to in this disclosure.

Conserved domain models are generally identified with multiple sequence alignments of related proteins spanning a variety of organisms (for example, conserved domains of the disclosed sequences can be found in the instant Figures, Tables, and the Sequence Listing). These alignments reveal sequence regions containing the same, or similar, patterns of amino acids. Multiple sequence alignments, three-dimensional structure and three-dimensional structure superposition of conserved domains can be used to infer sequence, structure, and functional relationships (Conserved Domain Database, supra). Since the presence of a particular conserved domain within a polypeptide (prophetically including any of the instantly listed polypeptides) is highly correlated with an evolutionarily conserved function, a conserved domain database may be used to identify the amino acids in a protein sequence that are putatively involved in functions such as binding or catalysis, as mapped from conserved domain annotations to the query sequence. For example, the presence in a protein of an AP2 domain, basic Helix-Loop-Helix (bHLH) domain, CBF/NF-Y domain, Zinc Finger (ZF) DNA binding domain or homeodomain DNA binding domain that is structurally and phylogenetically similar to one or more domains shown in the instant Tables would be a strong indicator of a related function in plants (e.g., the function of regulating and/or improving yield, light use efficiency, photosynthetic capacity, photosynthetic rate, photosynthetic resource use efficiency, vigor, and/or biomass as compared to a control plant; i.e., a polypeptide with such a domain is expected to confer altered yield, light use efficiency, photosynthetic capacity, photosynthetic rate, photosynthetic resource use efficiency, vigor, and/or biomass as compared to a control plant when its expression level is altered). Sequences herein referred to as functionally-related and/or closely-related to the sequences or domains listed in the instant Tables, including polypeptides that are closely related to the polypeptides of the instant description, may have conserved domains that share at least at least nine base pairs (bp) in length and at least 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95% or 96%, 97%, 98%, 99%, or about 100% amino acid identity to the sequences provided in the Sequence Listing or in the instant Tables, and have similar functions in that the polypeptides of the instant description. Said polypeptides may, when their expression level is altered by suppressing their expression, knocking out their expression, or increasing their expression, confer at least one regulatory activity selected from the group consisting of increased yield, increased light use efficiency, increased photosynthetic capacity, increased photosynthetic rate, increased photosynthetic resource use efficiency, greater vigor, and/or greater biomass as compared to a control plant.

Methods using manual alignment of sequences similar or homologous to one or more polynucleotide sequences or one or more polypeptides encoded by the polynucleotide sequences may be used to identify regions of similarity and conserved domains or other motifs. Such manual methods are well-known of those of skill in the art and can include, for example, comparisons of tertiary structure between a polypeptide sequence encoded by a polynucleotide that comprises a known function and a polypeptide sequence encoded by a polynucleotide sequence that has a function not yet determined. Such examples of tertiary structure may comprise predicted alpha helices, beta-sheets, amphipathic helices, leucine zipper motifs, zinc finger motifs, proline-rich regions, cysteine repeat motifs, and the like.

With respect to polynucleotides encoding presently disclosed polypeptides, a conserved domain refers to a subsequence within a polypeptide family (for example, in any of the instantly listed polypeptides or members of the listed polypeptide families) the presence of which is correlated with at least one function exhibited by members of the polypeptide family, and which exhibits a high degree of sequence homology, such as at least 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95% or 96%, 97%, 98%, 99%, or about 100% identity to a conserved domain of a polypeptide of the Sequence Listing or listed in the instant Tables that show the instant polypeptides and closely-related or phylogenetically-related sequences. Sequences that possess or encode for conserved domains that meet these criteria of percentage identity, and that have comparable biological and regulatory activity to the present polypeptide sequences, thus being members of the clade polypeptides or sequences listed in the sequence Listing or in Example I, are described. Sequences having lesser degrees of identity but comparable biological activity are considered to be equivalents.

Orthologs and Paralogs.

Homologous sequences as described above can comprise orthologous or paralogous sequences. Several different methods are known by those of skill in the art for identifying and defining these functionally homologous sequences. General methods for identifying orthologs and paralogs, including phylogenetic methods, sequence similarity and hybridization methods, are described herein; an ortholog or paralog, including equivalogs, may be identified by one or more of the methods described below.

As described by Eisen, 1998. *Genome Res.* 8: 163-167, evolutionary information may be used to predict gene function. It is common for groups of genes that are homologous in sequence to have diverse, although usually related, functions. However, in many cases, the identification of homologs is not sufficient to make specific predictions because not all homologs have the same function. Thus, an initial analysis of functional relatedness based on sequence similarity alone may not provide one with a means to determine where similarity ends and functional relatedness begins. Fortunately, it is well known in the art that protein function can be classified using phylogenetic analysis of gene trees combined with the corresponding species. Functional predictions can be greatly improved by focusing on how the genes became similar in sequence (i.e., by evolutionary processes) rather than on the sequence similarity itself (Eisen, supra). In fact, many specific examples exist in which gene function has been shown to correlate well with gene phylogeny (Eisen, supra). Thus, "[t]he first step in making functional predictions is the generation of a phylogenetic tree representing the evolutionary history of the gene of interest and its homologs. Such trees are distinct from clusters and other means of characterizing sequence similarity because they are inferred by techniques that help convert patterns of similarity into evolutionary relationships . . . . After the gene tree is inferred, biologically determined functions of the various homologs are overlaid onto the tree. Finally, the structure of the tree and the relative phylogenetic positions of genes of different functions are used to trace the history of functional changes, which is then used to predict functions of [as yet] uncharacterized genes" (Eisen, supra).

Within a single plant species, gene duplication may cause two copies of a particular gene, giving rise to two or more genes with similar sequence and often similar function known as paralogs. A paralog is therefore a similar gene formed by duplication within the same species. Paralogs typically cluster together or in the same clade (a group of similar genes) when a gene family phylogeny is analyzed using programs such as CLUSTAL (Thompson et al., 1994. *Nucleic Acids Res.* 22: 4673-4680; Higgins et al., 1996. *Methods Enzymol.* 266: 383-402). Groups of similar genes can also be identified with pair-wise BLAST analysis (Feng and Doolittle, 1987. *J. Mol. Evol.* 25: 351-360). For example, a clade of very similar MADS domain transcription factors from Arabidopsis all share a common function in flowering time (Ratcliffe et al., 2001. *Plant Physiol.* 126: 122-132), and a group of very similar AP2 domain transcription factors from Arabidopsis are involved in tolerance of plants to freezing (Gilmour et al., 1998. supra). Analysis of groups of similar genes with similar function that fall within one clade can yield sub-sequences that are particular to the clade. These sub-sequences, known as consensus sequences, can not only be used to define the sequences within each clade, but define the functions of these genes; genes within a clade may contain paralogous sequences, or orthologous sequences that share the same function (see also, for example, Mount, 2001, in *Bioinformatics: Sequence and Genome Analysis*, Cold Spring Harbor Laboratory Press, Cold Spring Harbor, N.Y., p. 543).

Regulatory polypeptide gene sequences are conserved across diverse eukaryotic species lines (Goodrich et al., 1993. *Cell* 75:519-530; Lin et al., 1991. *Nature* 353:569-571; Sadowski et al., 1988. *Nature* 335: 563-564). Plants are no exception to this observation; diverse plant species possess regulatory polypeptides that have similar sequences and functions. Speciation, the production of new species from a parental species, gives rise to two or more genes with similar sequence and similar function. These genes, termed orthologs, often have an identical function within their host plants and are often interchangeable between species without losing function. Because plants have common ancestors, many genes in any plant species will have a corresponding orthologous gene in another plant species. Once a phylogenic tree for a gene family of one species has been constructed using a program such as CLUSTAL (Thompson et al., 1994. supra; Higgins et al., 1996. supra) potential orthologous sequences can be placed into the phylogenetic tree and their relationship to genes from the species of interest can be determined. Orthologous sequences can also be identified by a reciprocal BLAST strategy. Once an orthologous sequence has been identified, the function of the ortholog can be deduced from the identified function of the reference sequence.

By using a phylogenetic analysis, one skilled in the art would recognize that the ability to deduce similar functions conferred by closely-related polypeptides is predictable. This predictability has been confirmed by our own many studies in which we have found that a wide variety of polypeptides have orthologous or closely-related homologous sequences that function as does the first, closely-related reference sequence. For example, distinct regulatory polypeptides, including:

(i) AP2 family *Arabidopsis* G47 (found in U.S. Pat. No. 7,135,616), a phylogenetically-related sequence from soybean, and two phylogenetically-related homologs from rice all can confer greater tolerance to drought, hyperosmotic stress, or delayed flowering as compared to control plants;

(ii) CAAT family *Arabidopsis* G481 (found in PCT patent publication no. WO2004076638), and numerous phylogenetically-related sequences from eudicots and monocots can confer greater tolerance to drought-related stress as compared to control plants;

(iii) Myb-related *Arabidopsis* G682 (found in U.S. Pat. Nos. 7,223,904 and 7,193,129) and numerous phylogenetically-related sequences from eudicots and monocots can confer greater tolerance to heat, drought-related stress, cold, and salt as compared to control plants;

(iv) WRKY family *Arabidopsis* G1274 (found in U.S. Pat. No. 7,196,245) and numerous closely-related sequences from eudicots and monocots have been shown to confer increased water deprivation tolerance, and (v) AT-hook family soy sequence G3456 (found in U.S. patent publication no. 20040128712A1) and numerous phylogenetically-related sequences from eudicots and monocots, increased biomass compared to control plants when these sequences are overexpressed in plants.

Examples of Methods for Identifying Identity, Similarity, Homology and Relatedness.

Percent identity can be determined electronically, e.g., by using the MEGALIGN program (DNASTAR, Inc. Madison, Wis.). The MEGALIGN program can create alignments between two or more sequences according to different methods, for example, the clustal method (see, for example, Higgins and Sharp, 1988. *Gene* 73: 237-244). The clustal algorithm groups sequences into clusters by examining the distances between all pairs. The clusters are aligned pairwise and then in groups. Other alignment algorithms or programs may be used for preparing alignments and/or determining percentage identities, including Accelrys Gene, FASTA, BLAST, or ENTREZ, FASTA and BLAST, some of which may also be used to calculate percent similarity. Accelrys Gene is available from Accelrys, Inc., San Diego, Calif. Other programs are available as a part of the GCG sequence analysis package (University of Wisconsin, Madison, Wis.), and can be used with or without default settings. ENTREZ is available through the National Center for Biotechnology Information. In one embodiment, the percent identity of two sequences can be determined by the GCG program with a gap weight of 1, e.g., each amino acid gap is weighted as if it were a single amino acid or nucleotide mismatch between the two sequences (see U.S. Pat. No. 6,262,333).

Software for performing BLAST analyses is publicly available, e.g., through the National Center for Biotechnology Information (see internet website at www.ncbi.nlm.nih.gov/). This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul, 1990. *J. Mol. Biol.* 215: 403-410; Altschul, 1993. *J. Mol. Evol.* 36: 290-300). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always>0) and N (penalty score for mismatching residues; always<0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, a cutoff of 100, M=5, N=−4, and a comparison of both strands. For amino acid sequences, the BLASTP program uses as defaults a wordlength (W) of 3, an expectation (E) of 10, and the BLOSUM62 scoring matrix (see Henikoff and Henikoff, 1989. supra; Henikoff and Henikoff, 1991. supra). Unless otherwise indicated for comparisons of predicted polynucleotides, "sequence identity" refers to the % sequence identity generated from a tBLASTx using the NCBI version of the algorithm at the default settings using gapped alignments with the filter "off" (see, for example, internet website at www.ncbi.nlm.nih.gov).

Other techniques for alignment are described by Doolittle, ed., 1996. *Methods in Enzymology*, vol. 266: "Computer Methods for Macromolecular Sequence Analysis" Academic Press, Inc., San Diego, Calif., USA. Preferably, an alignment program that permits gaps in the sequence is utilized to align the sequences. The Smith-Waterman is one type of algorithm that permits gaps in sequence alignments (see Shpaer, 1997. *Methods Mol. Biol.* 70: 173-187). Also, the GAP program using the Needleman and Wunsch alignment method can be utilized to align sequences. An alternative search strategy uses MPSRCH software, which runs on a MASPAR computer. MPSRCH uses a Smith-Waterman algorithm to score sequences on a massively parallel computer. This approach improves ability to pick up distantly related matches, and is especially tolerant of small gaps and nucleotide sequence errors. Nucleic acid-encoded amino acid sequences can be used to search both protein and DNA databases.

The percentage similarity between two polypeptide sequences, e.g., sequence A and sequence B, is calculated by dividing the length of sequence A, minus the number of gap residues in sequence A, minus the number of gap residues in sequence B, into the sum of the residue matches between sequence A and sequence B, times one hundred. Gaps of low or of no similarity between the two amino acid sequences are not included in determining percentage similarity. Percent identity between polynucleotide sequences can also be counted or calculated by other methods known in the art, e.g., the Jotun Hein method (see, for example, Hein, 1990. *Methods Enzymol.* 183: 626-645). Identity between sequences can also be determined by other methods known in the art, e.g., by varying hybridization conditions (see U.S. patent publication no. 20010010913).

The percent identity between two polypeptide sequences can also be determined using *Accelrys Gene* v2.5, 2006 with default parameters: Pairwise Matrix: GONNET; Align Speed: Slow; Open Gap Penalty: 10.000; Extended Gap Penalty: 0.100; Multiple Matrix: GONNET; Multiple Open Gap Penalty: 10.000; Multiple Extended Gap Penalty: 0.05; Delay Divergent: 30; Gap Separation Distance: 8; End Gap Separation: false; Residue Specific Penalties: false; Hydrophilic Penalties: false; Hydrophilic Residues: GPSNDQEKR. The default parameters for determining percent identity between two polynucleotide sequences using Accelrys Gene are: Align Speed: Slow; Open Gap Penalty: 10.000; Extended Gap Penalty: 5.000; Multiple Open Gap Penalty: 10.000; Multiple Extended Gap Penalty: 5.000; Delay Divergent: 40; Transition: Weighted.

In addition, one or more polynucleotide sequences or one or more polypeptides encoded by the polynucleotide sequences may be used to search against a BLOCKS (Bairoch et al., 1997. *Nucleic Acids Res.* 25: 217-221), PFAM, and other databases which contain previously identified and annotated motifs, sequences and gene functions. Methods that search for primary sequence patterns with secondary structure gap penalties (Smith et al., 1992. *Protein Engineering* 5: 35-51) as well as algorithms such as Basic Local Alignment Search Tool (BLAST; Altschul, 1990, supra; Altschul et al., 1993, supra), BLOCKS (Henikoff and Henikoff, 1991, supra), Hidden Markov Models (HMM; Eddy, 1996. *Curr. Opin. Str. Biol.* 6: 361-365; Sonnhammer et al., 1997. *Proteins* 28: 405-420), and the like, can be used to manipulate and analyze polynucleotide and polypeptide sequences encoded by polynucleotides. These databases, algorithms and other methods are well known in the art and are described in Ausubel et al., 1997. *Short Protocols in Molecular Biology*, John Wiley & Sons, New York, N.Y., unit 7.7, and in Meyers, 1995. *Molecular Biology and Biotechnology*, Wiley VCH, New York, N.Y., p 856-853.

Thus, the instant description provides methods for identifying a sequence similar or paralogous or orthologous or homologous to one or more polynucleotides as noted herein, or one or more target polypeptides encoded by the polynucleotides, or otherwise noted herein and may include linking or associating a given plant phenotype or gene function with a sequence. In the methods, a sequence database is provided (locally or across an internet or intranet) and a query is made against the sequence database using the relevant sequences herein and associated plant phenotypes or gene functions.

A further method for identifying or confirming that specific homologous sequences control the same function is by comparison of the transcript profile(s) obtained upon overexpression or knockout of two or more related polypeptides. Since transcript profiles are diagnostic for specific cellular states, one skilled in the art will appreciate that genes that have a highly similar transcript profile (e.g., with greater than 50% regulated transcripts in common, or with greater than 70% regulated transcripts in common, or with greater than 90% regulated transcripts in common) will have highly similar functions. Fowler and Thomashow, 2002. *Plant Cell* 14, 1675-1690, have shown that three paralogous AP2 family genes (CBF1, CBF2 and CBF3) are induced upon cold treatment, each of which can condition improved freezing tolerance, and all have highly similar transcript profiles. Once a polypeptide has been shown to provide a specific function, its transcript profile becomes a diagnostic tool to determine whether paralogs or orthologs have the same function.

Identifying Polynucleotides or Nucleic Acids by Hybridization.

Polynucleotides homologous to the sequences illustrated in the Sequence Listing and tables can be identified, e.g., by hybridization to each other under stringent or under highly stringent conditions. Stringency is influenced by a variety of factors, including temperature, salt concentration and composition, organic and non-organic additives, solvents, etc. present in both the hybridization and wash solutions and incubations, and the number of washes, as described in more detail in the references cited below (e.g., Sambrook et al., 1989. supra; Berger and Kimmel, eds., 1987. *Methods Enzymol.* 152: 507-511; Anderson and Young, 1985. "Quantitative Filter Hybridisation", In: Hames and Higgins, ed., *Nucleic Acid Hybridisation, A Practical Approach*. Oxford, IRL Press, 73-111), each of which are incorporated herein by reference. Conditions that are highly stringent, and means for achieving them, are also well known in the art and described in, for example, Sambrook et al., 1989. supra; Berger and Kimmel, eds., 1987. *Meth. Enzymol.* 152:467-469; and Anderson and Young, 1985. supra.

Also provided in the instant description are polynucleotide sequences that are capable of hybridizing to the claimed polynucleotide sequences, including any of the polynucleotides within the Sequence Listing, and fragments thereof under various conditions of stringency (see, for example, Wahl and Berger, 1987. *Methods Enzymol.* 152: 399-407; Berger and Kimmel, ed., 1987. *Methods Enzymol.* 152:507-511). In addition to the nucleotide sequences listed in the Sequence Listing, full length cDNA, orthologs, and paralogs of the present nucleotide sequences may be identified and isolated using well-known methods. The cDNA libraries, orthologs, and paralogs of the present nucleotide sequences may be screened using hybridization methods to determine their utility as hybridization target or amplification probes.

Stability of DNA duplexes is affected by such factors as base composition, length, and degree of base pair mismatch. Hybridization conditions may be adjusted to allow DNAs of different sequence relatedness to hybridize. The melting temperature ($T_m$) is defined as the temperature when 50% of the duplex molecules have dissociated into their constituent single strands. The melting temperature of a perfectly matched duplex, where the hybridization buffer contains formamide as a denaturing agent, may be estimated by the following equations:

DNA-DNA:
$$T_m(° C.) = 81.5 + 16.6(\log [\text{Na}+]) + 0.41(\%G+C) - 0.62(\% \text{ formamide}) - 500/L \quad \text{(I)}$$

DNA-RNA:
$$T_m(° C.) = 79.8 + 18.5(\log [\text{Na}+]) + 0.58(\% G+C) + 0.12(\% G+C)^2 - 0.5(\% \text{ formamide}) - 820/L \quad \text{(II)}$$

RNA-RNA:
$$T_m(° C.) = 79.8 + 18.5(\log [\text{Na}+]) + 0.58(\% G+C) + 0.12(\% G+C)^2 - 0.35(\% \text{ formamide}) - 820/L \quad \text{(III)}$$

where L is the length of the duplex formed, [Na+] is the molar concentration of the sodium ion in the hybridization or washing solution, and % G+C is the percentage of (guanine+cytosine) bases in the hybrid. For imperfectly matched hybrids, approximately 1° C. is required to reduce the melting temperature for each 1% mismatch.

Hybridization experiments are generally conducted in a buffer of pH between 6.8 to 7.4, although the rate of hybridization is nearly independent of pH at ionic strengths likely to be used in the hybridization buffer (Anderson and Young, 1985. supra). In addition, one or more of the following may be used to reduce non-specific hybridization: sonicated salmon sperm DNA or another non-complementary DNA, bovine serum albumin, sodium pyrophosphate, sodium dodecylsulfate (SDS), polyvinyl-pyrrolidone, ficoll and Denhardt's solution. Dextran sulfate and polyethylene glycol 6000 act to exclude DNA from solution, thus raising the effective probe DNA concentration and the hybridization signal within a given unit of time. In some instances, conditions of even greater stringency may be desirable or required to reduce non-specific and/or background hybridization. These conditions may be created with the use of higher temperature, lower ionic strength and higher concentration of a denaturing agent such as formamide.

Stringency conditions can be adjusted to screen for moderately similar fragments such as homologous sequences from distantly related organisms, or to highly similar fragments such as genes that duplicate functional enzymes from closely related organisms. The stringency can be adjusted either during the hybridization step or in the post-hybridization washes. Salt concentration, formamide concentration, hybridization temperature and probe lengths are variables that can be used to alter stringency (as described by the formula above). As a general guideline, high stringency is typically performed at $T_m-5°$ C. to $T_m-20°$ C., moderate stringency at $T_m-20°$ C. to $T_m-35°$ C. and low stringency at $T_m-35°$ C. to $T_m-50°$ C. for duplex>150 base pairs. Hybridization may be performed at low to moderate stringency (25-50° C. below $T_m$), followed by post-hybridization washes at increasing stringencies. Maximum rates of hybridization in solution are determined empirically at $T_m-25°$ C. for DNA-DNA duplex and $T_m-15°$ C. for RNA-DNA duplex. Optionally, the degree of dissociation may be assessed after each wash step to determine the need for subsequent, higher stringency wash steps.

High stringency conditions may be used to select for nucleic acid sequences with high degrees of identity to the disclosed sequences. An example of stringent hybridization conditions obtained in a filter-based method such as a Southern or Northern blot for hybridization of complementary nucleic acids that have more than 100 complementary residues is about 5° C. to 20° C. lower than the thermal melting point ($T_m$) for the specific sequence at a defined ionic strength and pH. Conditions used for hybridization may include about 0.02 M to about 0.15 M sodium chloride, about 0.5% to about 5% casein, about 0.02% SDS or about 0.1% N-laurylsarcosine, about 0.001 M to about 0.03 M sodium citrate, at hybridization temperatures between about 50° C. and about 70° C. More preferably, high stringency conditions are about 0.02 M sodium chloride, about 0.5% casein, about 0.02% SDS, about 0.001 M sodium citrate, at a temperature of about 50° C. Nucleic acid molecules that hybridize under stringent conditions will typically hybridize to a probe based on either the entire DNA molecule or selected portions, e.g., to a unique subsequence, of the DNA.

Stringent salt concentration will ordinarily be less than about 750 mM NaCl and 75 mM trisodium citrate. Increasingly stringent conditions may be obtained with less than about 500 mM NaCl and 50 mM trisodium citrate, to even greater stringency with less than about 250 mM NaCl and 25 mM trisodium citrate. Low stringency hybridization can be obtained in the absence of organic solvent, e.g., formamide, whereas high stringency hybridization may be obtained in the presence of at least about 35% formamide, and more preferably at least about 50% formamide. Stringent temperature conditions will ordinarily include temperatures of at least about 30° C., more preferably of at least about 37° C., and most preferably of at least about 42° C. with formamide present. Varying additional parameters, such as hybridization time, the concentration of detergent, e.g., sodium dodecyl sulfate (SDS) and ionic strength, are well known to those skilled in the art. Various levels of stringency are accomplished by combining these various conditions as needed.

The washing steps that follow hybridization may also vary in stringency; the post-hybridization wash steps primarily determine hybridization specificity, with the most critical factors being temperature and the ionic strength of the final wash solution. Wash stringency can be increased by decreasing salt concentration or by increasing temperature. Stringent salt concentration for the wash steps will preferably be less than about 30 mM NaCl and 3 mM trisodium citrate, and most preferably less than about 15 mM NaCl and 1.5 mM trisodium citrate.

Thus, high stringency hybridization and wash conditions that may be used to bind and remove polynucleotides with less than the desired homology to the nucleic acid sequences or their complements that encode the present polypeptides include, for example:

6×SSC at 65° C.;
50% formamide, 4×SSC at 42° C.; or
0.5×SSC, 0.1% SDS at 65° C.;
with, for example, two wash steps of 10-30 minutes each. Useful variations on these conditions will be readily apparent to those skilled in the art.

A person of skill in the art would not expect substantial variation among polynucleotide species provided with the present description because the highly stringent conditions set forth in the above formulae yield structurally similar polynucleotides.

If desired, one may employ wash steps of even greater stringency, including about 0.2×SSC, 0.1% SDS at 65° C. and washing twice, each wash step being about 30 minutes, or about 0.1×SSC, 0.1% SDS at 65° C. and washing twice for 30 minutes. The temperature for the wash solutions will ordinarily be at least about 25° C., and for greater stringency at least about 42° C. Hybridization stringency may be increased further by using the same conditions as in the hybridization steps, with the wash temperature raised about 3° C. to about 5° C., and stringency may be increased even further by using the same conditions except the wash temperature is raised about 6° C. to about 9° C. For identification of less closely related homologs, wash steps may be performed at a lower temperature, e.g., 50° C.

An example of a low stringency wash step employs a solution and conditions of at least 25° C. in 30 mM NaCl, 3 mM trisodium citrate, and 0.1% SDS over 30 minutes. Greater stringency may be obtained at 42° C. in 15 mM NaCl, with 1.5 mM trisodium citrate, and 0.1% SDS over 30 minutes. Even higher stringency wash conditions are obtained at 65° C.-68° C. in a solution of 15 mM NaCl, 1.5 mM trisodium citrate, and 0.1% SDS. Wash procedures will generally employ at least two final wash steps. Additional variations on these conditions will be readily apparent to those skilled in the art (see, for example, U.S. patent publication no. 20010010913).

Stringency conditions can be selected such that an oligonucleotide that is perfectly complementary to the coding oligonucleotide hybridizes to the coding oligonucleotide with at least about a 5-10× higher signal to noise ratio than the ratio for hybridization of the perfectly complementary oligonucleotide to a nucleic acid encoding a polypeptide known as of the filing date of the application. It may be desirable to select conditions for a particular assay such that a higher signal to noise ratio, that is, about 15× or more, is obtained. Accordingly, a subject nucleic acid will hybridize to a unique coding oligonucleotide with at least a 2× or greater signal to noise ratio as compared to hybridization of the coding oligonucleotide to a nucleic acid encoding known polypeptide. The particular signal will depend on the label used in the relevant assay, e.g., a fluorescent label, a colorimetric label, a radioactive label, or the like. Labeled hybridization or PCR probes for detecting related polynucleotide sequences may be produced by oligolabeling, nick translation, end-labeling, or PCR amplification using a labeled nucleotide.

The present description also provides polynucleotide sequences that are capable of hybridizing to the claimed polynucleotide sequences, including any of the polynucleotides within the Sequence Listing, and fragments thereof under various conditions of stringency (see, for example, Wahl and Berger, 1987, supra, pages 399-407; and Kimmel, 1987. *Meth. Enzymol.* 152, 507-511). In addition to the nucleotide sequences in the Sequence Listing, full length cDNA, orthologs, and paralogs of the present nucleotide sequences may be identified and isolated using well-known methods. The cDNA libraries, orthologs, and paralogs of the present nucleotide sequences may be screened using hybridization methods to determine their utility as hybridization target or amplification probes.

EXAMPLES

It is to be understood that this description is not limited to the particular devices, machines, materials and methods described. Although particular embodiments are described, equivalent embodiments may be used to practice the claims.

The specification, now being generally described, will be more readily understood by reference to the following examples, which are included merely for purposes of illustration of certain aspects and embodiments of the present description and are not intended to limit the claims or description. It will be recognized by one of skill in the art that a polypeptide that is associated with a particular first trait may also be associated with at least one other, unrelated and inherent second trait which was not predicted by the first trait.

Example I. The Instant Polynucleotides and Their Encoded or Predicted Polypeptides The instant polypeptides sequences belong to distinct clades of polypeptides that include members from diverse species. In each case, clade member sequences derived from both eudicots and monocots may be shown to confer increased yield or tolerance to one or more abiotic stresses when the sequences were overexpressed. These studies can demonstrate that evolutionarily conserved genes from diverse species are likely to function similarly (i.e., by regulating similar target sequences and controlling the same traits), and that polynucleotides from one species may be transformed into closely-related or distantly-related plant species to confer or improve traits.

The listed polypeptide sequences may be found within the polypeptide clades of Ethylene-Responsive transcription Factor 15 ("ERF015"; AT4G31060.1; G39, AP2 family), basic Helix-Loop-Helix 31 (AtbHLH031"; AT1G59640.1; G2520, HLH/MYC family), CCAAT-box binding transcription factor NF-YC8 ("Hap5a"; AT5G27910.1; G1836, Histone-like transcription factor (CBF/NF-Y) family), GATA binding protein 4 ("GATA4"; AT3G60530.1; G342, ZnF_GATA family), WUSCHEL ("WUS"; AT2G17950; G1540, homeodomain family), Ethylene-Responsive Factor ERF054 ("ERF054"; AT4G28140; G1845, AP2 family), ABORTED MICROSPORES ("AMS"; "AtbHLH021"; AT2G16910; G1135, HLH/MYC family), and WUSCHEL RELATED HOMEOBOX 1 ("WOX1", AT3G18010; G1539).

Orthologs and paralogs of presently disclosed polypeptides may be cloned using compositions provided by the present description according to methods well known in the art. cDNAs can be cloned using mRNA from a plant cell or tissue that expresses one of the present sequences. Appropriate mRNA sources may be identified by interrogating Northern blots with probes designed from the present sequences, after which a library is prepared from the mRNA obtained from a positive cell or tissue. Polypeptide-encoding cDNA is then isolated using, for example, PCR, using primers designed from a presently disclosed gene sequence, or by probing with a partial or complete cDNA or with one or more sets of degenerate probes based on the disclosed sequences. The cDNA library may be used to transform plant cells. Expression of the cDNAs of interest is detected using, for example, microarrays, Northern blots, quantitative PCR, or any other technique for monitoring changes in expression. Genomic clones may be isolated using similar techniques to those.

Examples of orthologs of the *Arabidopsis* polypeptide sequences and their functionally similar orthologs are listed in the instant Tables and the Sequence Listing. In addition to the sequences in the instant Tables and the Sequence Listing, the claimed nucleotide sequences are phylogenetically and structurally similar to sequences listed in the Sequence Listing and can function in a plant by increasing yield, light use efficiency, photosynthetic capacity, photosynthetic rate, photosynthetic resource use efficiency, vigor, and/or biomass as compared to a control plant when ectopically expressed, or overexpressed, in a plant. Since a significant number of these sequences are phylogenetically and sequentially related to each other and may be shown to increase yield from a plant and/or photosynthetic resource use efficiency, one skilled in the art would predict that other similar, phylogenetically related sequences falling within the present clades of polypeptides, including ERF015, AtbHLH031, NF-YC8, GATA4, WUS, ERF054, AMS, or WOX1 clade polypeptide sequences, would also perform similar functions when ectopically expressed.

Background Information for ERF015, AtbHLH031, NF-YC8, GATA4, WUS, ERF054, AMS, or WOX1, and their Clade Member Sequences.

A number of phylogenetically-related sequences have been found in other plant species. Sequences that are functionally-related and/or closely-related to the polypeptides in the following Tables 2-10 may be created artificially, semi-synthetically, or may occur naturally by having descended from the same ancestral sequence as the disclosed closely-related sequences, where the polypeptides have the function of conferring increased photosynthetic resource use efficiency to plants. These Tables list a number of ERF015, AtbHLH031, NF-YC8, GATA4, WUS, ERF054, AMS, or WOX1 clade sequences from diverse species. The tables include the SEQ ID NO: (Column 1), the species from which the sequence was derived and the Gene Identifier ("GID"; Column 2), the percent identity of the polypeptide in Column 1 to the first listed full length polypeptide (SEQ ID NO: 2, 62, 106, 138, 174, 204, 246, or 282), as determined by a BLASTp analysis, for example, with a wordlength (W) of 3, an expectation (E) of 10, and the BLOSUM62 scoring matrix (Henikoff and Henikoff, 1989. *Proc. Natl. Acad. Sci. USA* 89:10915; Henikoff and Henikoff, 1991. *Nucleic Acids Res.* 19: 6565-6572) (Column 3), the amino acid residue coordinates for the conserved domains in amino acid coordinates beginning at the N-terminus, of each of the sequences (Column 4), the conserved domain sequences of the respective polypeptides (Column 5); the SEQ ID NO: of each of the domains (Column 6), and the percentage identity of the conserved domain in Column 5 to the conserved domain of the first listed sequence (as determined by a BLASTp analysis, wordlength (W) of 3, an expectation (E) of 10, and the BLOSUM62 scoring matrix, and with the proportion of identical amino acids in parentheses; Column 7).

Species abbreviations that appear in Columns 2 of the following Tables include: At—*Arabidopsis thaliana*; Bd—*Brachypodium distachyon*; Cc—*Citrus clementina*; Eg—*Eucalyptus grandis*; Gm—*Glycine max*; Os—*Oryza sativa*; Pt—*Populus trichocarpa*; Si—*Setaria italica*; Sl—*Solanum lycopersicum*; Vv—*Vitus vinifera*; Zm—*Zea mays*.

ERF015 (AT4G31060.1 or G39) Clade Polypeptides

TABLE 2

Conserved 'AP2 domain' of ERF015 and closely related sequences

| Col. 1 SEQ ID NO: | Col. 2 Species/ Identifier | Col. 3 Percent identity of polypeptide in Col. 1 to ERF015 | Col. 4 AP2 domain in amino acid coordinates | Col. 5 Conserved APS domain | Col. 6 SEQ ID NO: of AP2 domain | Col. 7 Percent identity of the AP2 domain in Col. 5 to the AP2 domain of ERF015 |
|---|---|---|---|---|---|---|
| 2 | At/ERF015 (AT4G31060.1) | 100% (187/187) | 26-75 | CYRGVRKRSWGKWV SEIRVPKTGRRIWL GSYDAPEKAARAYD AALFCIRG | 329 | 100% (50/50) |
| 4 | Pt/POPTR_0006 s08000.1 | 53% (92/171) | 21-70 | TYRGVRMRTWGKWV SEIRVPKTGQRIWL GSYDAPEKAARAYD AAQYCIRG | 330 | 88% (44/50) |
| 6 | Vv/GSVIVT010 35502001 | 58% (50/86) | 24-73 | KYKGVRKRKWGKWV SEIRLPNSRERIWL GSYDTPEKAARAFD AALFCLRG | 331 | 78% (39/50) |
| 8 | Sl/Solyc12g0092 40.1.1 | 55% (49/89) | 19-68 | LYRGVRKRKWGKWV SEIRLPNSRERIWL GSYDTPEKAAKAFD AALFCLRG | 332 | 78% (39/50) |
| 10 | At/AT1G74930.1 | 45% (55/121) | 20-69 | KYKGVRKRKWGKWV SEIRLPHSRERIWL GSYDTPEKAARAFD AAQFCLRG | 333 | 76% (38/50) |
| 12 | At/AT1G19210.1 | 40% (59/144) | 11-60 | KYKGVRKRKWGKWV SEIRLPNSRERIWL GSYDTPEKAARAFD AALYCLRG | 334 | 76% (38/50) |
| 14 | Pt/POPTR_0006 s23480.1 | 44% (58/131) | 24-73 | KYKGVRKRKWGKWV SEIRLPNSRERIWL GSYDTPEKAARAFD AALYCLRG | 335 | 76% (38/50) |

TABLE 2-continued

Conserved 'AP2 domain' of ERF015 and closely related sequences

| Col. 1 SEQ ID NO: | Col. 2 Species/ Identifier | Col. 3 Percent identity of polypeptide in Col. 1 to ERF015 | Col. 4 AP2 domain in amino acid coordinates | Col. 5 Conserved APS domain | Col. 6 SEQ ID NO: of AP2 domain | Col. 7 Percent identity of the AP2 domain in Col. 5 to the AP2 domain of ERF015 |
|---|---|---|---|---|---|---|
| 16 | Gm/Glyma04g0 6100.1 | 53% (48/89) | 1-50 | LYKGVRKRKWGKWV SEIRLPNSRERIWL GSYDSPEKAARAFD AALYCLRG | 336 | 76% (38/50) |
| 18 | Gm/Glyma06g0 6100.1 | 44% (52/116) | 24-73 | LYKGVRKRKWGKWV SEIRLPNSRERIWL GSYDSPEKAARAFD AALYCLRG | 337 | 76% (38/50) |
| 20 | Gm/Glyma17g0 5240.1 | 53% (52/98) | 17-66 | YYKGVRKRKWGKWV SEIRLPNSRQRIWL GSYDTPEKAARAFD AAMFCLRG | 338 | 76% (38/50) |
| 22 | Vv/GSVIVT010 15037001 | 53% (46/86) | 91-140 | RYKGVRKRKWGKWV SEIRLPNSRERIWL GSYDTAEKAARAFD AALYCLRG | 339 | 74% (37/50) |
| 24 | Gm/Glyma09g0 8330.1 | 51% (49/95) | 21-70 | SYRGVRKRKWGKYV SEIRLPNSRQRIWL GSYDSAEKAARAFD AAMFCLRG | 340 | 74% (37/50) |
| 26 | Pt/POPTR_0018 s08320.1 | 46% (63/135) | 19-68 | KYKGVRKRKWGKWV SEIRLPNSRERIWL GSYDTPLKAARAFD AALYCLRG | 341 | 74% (37/50) |
| 28 | Pt/POPTR_0006 s14100.1 | 58% (54/93) | 17-66 | KFKGVRKRKWGKWV SEIRLPNSRERIWL GSYDSAEKAARAFD AALFCLRG | 342 | 74% (37/50) |
| 30 | Gm/Glyma13g1 7250.1 | 52% (51/97) | 18-67 | YYKGVRKRKWGKWV SEIRLPNSRQRIWL GSFDTPEKAARAFD AAMFCLRG | 343 | 74% (37/50) |
| 32 | Zm/GRMZM2G 097081_T01 | 62% (44/70) | 18-67 | KFKGVRKRKWGKWV SEIRLPNSRERIWL GSYDAPDKAARAFD AAFVCLRG | 344 | 72% (36/50) |
| 34 | Os/LOC_Os06g 09717.1 | 64% (40/62) | 11-60 | KYRGVRLRKWGKWV SEIRLPNSRERIWL GSYDTPEEAARAFD AAFVCLRG | 345 | 72% (36/50) |
| 36 | Os/LOC_Os06g 09760.1 | 66% (39/59) | 21-70 | KYRGVRLRQWGKWV AEIRLPNSLKRIWL GSYDSPEKAARAFD AAFICLRG | 346 | 72% (36/50) |
| 38 | Pt/POPTR_0006 s14090.1 | 45% (55/122) | 17-66 | KYKGVRKRKWGRWV SEIRLPNSRERIWL GSYDSAEKAAHAFD AALFCLRG | 347 | 72% (36/50) |

TABLE 2-continued

Conserved 'AP2 domain' of ERF015 and closely related sequences

| Col. 1 SEQ ID NO: | Col. 2 Species/ Identifier | Col. 3 Percent identity of polypeptide in Col. 1 to ERF015 | Col. 4 AP2 domain in amino acid coordinates | Col. 5 Conserved APS domain | Col. 6 SEQ ID NO: of AP2 domain | Col. 7 Percent identity of the AP2 domain in Col. 5 to the AP2 domain of ERF015 |
|---|---|---|---|---|---|---|
| 40 | At/AT5G21960.1 | 53% (49/92) | 6-55 | KYTGVRKRKWGKWV AEIRLPNSRDRIWL GSFDSAEKAARAFD AALYCLRG | 348 | 70% (35/50) |
| 42 | Os/LOC_Os02g 54050.1 | 45% (46/102) | 18-67 | KYKGVRRRKWGKWV SEIRLPNSRDRIWL GSYDSPEKAARAFD AAFVTLRG | 349 | 70% (35/50) |
| 44 | Gm/Glyma15g1 9910.1 | 55% (47/85) | 13-62 | VHVGVRKRKWGKYV SEIRLPNSRQRIWL GSYDSAEKAARAFD AAMFCLRG | 350 | 70% (35/50) |
| 46 | Gm/Glyma17g3 3530.1 | 48% (50/103) | 1-50 | MFKGVRKRKWGKWV SEIRLPNSRERIWL GSYDTQVKAARAFD AALYCLRG | 351 | 70% (35/50) |
| 48 | Sl/Solyc06g0546 30.1.1 | 54% (51/94) | 11-60 | KFKGVRLRKWGKWV SEVRLPNSRDRIWL GSYDSAEKAARAFD AAQFCLRG | 352 | 68% (34/50) |
| 50 | Os/LOC_Os06g 09810.1 | 44% (57/127) | 29-78 | KYKGVRLRQWGKWA AEIRLPSSCERIWL GSYDTPEKAARAFD AAFICLRG | 353 | 68% (34/50) |
| 52 | Os/LOC_Os06g 09790.1 | 46% (40/86) | 15-64 | RYKGVRLRQWGKWV AEIRLPNSRKRIWL GSYYTPEKAARAFD AAFICLRG | 354 | 68% (34/50) |
| 54 | Os/LOC_Os08g 35240.1 | 57% (38/66) | 26-75 | RYKGVRLRKWGRWV SEIRMPNSRERIWL GSYESAEKAARAFD AAAVCLRG | 355 | 66% (33/50) |
| 56 | Os/LOC_Os06g 11940.1 | 55% (38/68) | 31-80 | KYKGVRLRQWGKWV AEIRLPNSRERVWL GSYDTPEKAARAFD AAFVFLRG | 356 | 66% (33/50) |
| 58 | Bd/Bradi3g37544.1 | 39% (56/141) | 15-64 | RYKGVRLRKWGRWV SEIRMPNSRERIWL GSYESAEKAALAFD AAAVCLRG | 357 | 64% (32/50) |
| 60 | Zm/GRMZM2G 163745_T01 | 62% (36/58) | 24-73 | RYKGVRLRKWGRWV SEIRMPNSRERVWL GSYESAEKAARAFD AAAVCLRG | 358 | 64% (32/50) |

These functionally-related and/or closely-related ERF015 clade polypeptides may be identified by a consensus AP2 domain sequence, SEQ ID NO: 511: $X^1X^2X^3GVRX^7RX^9WGX^{12}X^{13}X^{14}X^{15}EX^{17}RX^{19}PX^{21}X^{22}X^{23}X^{24}RX^{26}WLGSX^{31}X^{32}X^{33}X^{34}X^{35}X^{36}AA\ X^{39}AX^{41}DA\ AX^{45}X^{46}X^{47}X^{48}RG$ where $X^1$=any amino acid; $X^2$=any amino acid; $X^3$=any amino acid; $X^7$=any amino acid; $X^9$=any amino acid; $X^{12}$=K or R; $X^{13}$=W or Y; $X^{14}$=A or V; $X^{15}$=A or S; $X^{17}$=I, L, M or V; $X^{19}$=I, L, M or V; $X^{21}$=any amino acid; $X^{22}$=S or T; $X^{23}$=any amino acid; $X^{24}$=D, E, K, Q or R; $X^{26}$=I, L, M or V; $X^{31}$=F or Y; $X^{32}$=any amino acid; $X^{33}$=A, S or T; $X^{34}$=any amino acid; $X^{35}$=any amino acid; $X^{36}$=any amino acid; $X^{39}$=any amino acid; $X^{41}$=F or Y; $X^{45}$=any amino acid; $X^{46}$=F, Y, I, L, M or V; $X^{47}$=any amino acid; and $X^{48}$=I, L, M or V.

AtbHLH031 (AT1G59640.1 or G2520) Clade Polypeptides

TABLE 3

Conserved 'HLH domain' of AtbHLH031 and closely related sequences

| Col. 1 SEQ ID NO: | Col. 2 Species/ Identifier | Col. 3 Percent identity of polypeptide in Col. 1 to AtbHLH031 | Col. 4 bHLH domain in amino acid coordinates | Col. 5 Conserved bHLH domain | Col. 6 SEQ ID NO: of bHLH domain | Col. 7 Percent identity of the bHLH domain in Col. 5 to the bHLH domain of AtbHLH031 |
|---|---|---|---|---|---|---|
| 62 | At/AtbHLH031 (AT1G59640.1) | 100% (264/264) | 140-197 | RGQATDSHSLAERAR REKISERMKILQDLV PGCNKVIGKALVLDE IINYIQSLQRQVE | 359 | 100% (58/58) |
| 64 | Gm/Glyma04g 34660.1 | 63% (126/197) | 118-175 | RGQATDSHSLAERAR REKISERMKILQDLV PGCNKVIGKALVLDE IINYIQSLQRQVE | 360 | 100% (58/58) |
| 66 | Gm/Glyma06g 20000.1 | 61% (127/205) | 143-200 | RGQATDSHSLAERAR REKISERMKILQDLV PGCNKVIGKALVLDE IINYIQSLQRQVE | 361 | 100% (58/58) |
| 68 | Pt/POPTR_001 0s04920.1 | 57% (156/270) | 119-176 | RGQATDSHSLAERAR REKISERMKILQDLV PGCNKVIGKALVLDE IINYIQSLQRQVE | 362 | 100% (58/58) |
| 70 | Gm/Glyma01g 04610.1 | 56% (155/276) | 141-198 | RGQATDSHSLAERAR REKISERMKILQDIV PGCNKVIGKALVLDE IINYIQSLQRQVE | 363 | 98% (57/58) |
| 72 | Os/LOC_Os07 g09590.1 | 73% (101/137) | 132-189 | RGQATDSHSLAERAR REKISERMKILQDLV PGCNKVIGKASVLDE IINYIQSLQHQVE | 364 | 96% (56/58) |
| 74 | Si/Si030790m | 68% (95/139) | 145-202 | RGQATDSHSLAERAR REKISERMKVLQDLV PGCNKVIGKASVLDE IINYIQSLQRQVE | 365 | 96% (56/58) |
| 76 | Sl/Solyc04g005 130.2.1 | 67% (132/196) | 104-161 | RGQATDSHSLAERAR REKISDRMKILQDLV PGCNKVIGKALVLDE IINYVQSLQRQVE | 366 | 96% (56/58) |
| 78 | Gm/Glyma17g 10290.1 | 62% (118/188) | 104-161 | RGQATDSHSLAERAR REKISERMKILQDIV PGCNKVIGKALVLDE IINYIQSLQHQVE | 367 | 96% (56/58) |
| 80 | Pt/POPTR_000 8s19510.1 | 53% (153/286) | 145-202 | RGQATDSHSLAERAR REKISERMKILQDIV PGCNKVTGKALVLDE IINYIQSLQRQVE | 368 | 96% (56/58) |
| 82 | Eucgr.K02908.1 | 52% (140/269) | 152-209 | RGQATDSHSLAERAR REKISERMKILQDLV PGCNKVIGKALILDE IINYIQSLQNQVE | 369 | 96% (56/58) |
| 84 | Os/LOC_Os03 g58830.1 | 48% (141/290) | 140-197 | RGQATDSHSLAERAR REKISERMKILQDLV PGCNKVIGKASVLDE IINYIQALQRQVE | 370 | 96% (56/58) |
| 86 | Si/Si037131m | 58% (126/215) | 130-187 | RGQATDSHSLAERAR REKISERMKVLQDLV PGCNKVIGKASVLDE IINYIQSLQCQVE | 371 | 94% (55/58) |

TABLE 3-continued

Conserved 'HLH domain' of AtbHLH031 and closely related sequences

| Col. 1 SEQ ID NO: | Col. 2 Species/ Identifier | Col. 3 Percent identity of polypeptide in Col. 1 to AtbHLH031 | Col. 4 bHLH domain in amino acid coordinates | Col. 5 Conserved bHLH domain | Col. 6 SEQ ID NO: of bHLH domain | Col. 7 Percent identity of the bHLH domain in Col. 5 to the bHLH domain of AtbHLH031 |
|---|---|---|---|---|---|---|
| 88 | Gm/Glyma05g 01590.1 | 57% (113/196) | 103-160 | RGQATDNHSLAERAR REKISERMKILQDLV PGCNKVIGKAFVLDE IINYVQSLQRQVE | 372 | 94% (55/58) |
| 90 | Sl/Solyc05g006 650.2.1 | 55% (160/286) | 150-207 | RGQATDSHSLAERAR REKISERMKVLQDIV PGCNKVIGKALVLDE IINYIQSLQHQVE | 373 | 94% (55/58) |
| 92 | Eucgr.B03392.1 | 55% (155/281) | 154-211 | RGQATDSHSLAERAR REKISERMKILQDIV PGCNKVIGRALVLDE IINYIQSLQHQVE | 374 | 94% (55/58) |
| 94 | Zm/GRMZM2 G137358_T01 | 54% (131/241) | 130-187 | RGQATDSHSLAERAR REKISERMKVLQDLV PGCNKVIGKASVLDE IINYIQSLQCQVE | 375 | 94% (55/58) |
| 96 | Eucgr.B00385.1 | 51% (141/276) | 146-203 | RGQATDSHSLAERAR REKISERMKTLQDLV PGCNKIIGKALVLDE IINYIQSLQHQVE | 376 | 94% (55/58) |
| 98 | Pt/POPTR_001 5s07930.1 | 50% (138/274) | 149-206 | RGQATDSHSLAERAR REKISERMNMLQDLV PGCNKVIGKALVLDE IINYIQSLQCQVE | 377 | 94% (55/58) |
| 100 | Zm/GRMZM2 G008898_T01 | 49% (116/233) | 127-184 | RGQATDSHSLAERAR REKISERMKVLQDIV PGCNKVIGKASVLDE IINYIQSLQRQVE | 378 | 94% (55/58) |
| 102 | Pt/POPTR_001 2s07470.1 | 48% (132/272) | 147-204 | RGQATDSHSLAERAR RERIGERMKILQDLV PGCNKVIGKALALDE IINYIQSLQCQVE | 379 | 93% (54/58) |
| 104 | At/AT5G62610.1 | 43% (120/279) | 157-214 | RGQATDRHSLAERAR REKISEKMTALQDII PGCNKIIGKALVLDE IINYIQSLQRQVE | 380 | 87% (51/58) |

These functionally-related and/or closely-related AtbHLH031 clade polypeptides may be identified by a consensus bHLH domain sequence, SEQ ID NO: 512:
RGQATDX$^{7}$HSLAERARREX$^{18}$IX$^{20}$X$^{21}$X$^{22}$MX$^{24}$X$^{25}$LQ DX$^{29}$X$^{30}$PGCNKX$^{36}$X$^{37}$GX$^{39}$AX$^{41}$X$^{42}$LDEIINYX$^{50}$Q X$^{52}$LQX$^{55}$QVE where X$^{7}$=any amino acid; X$^{18}$=K or R; X$^{20}$=S or G; X$^{21}$=D or E; X$^{22}$=K or R; X$^{24}$=any amino acid; X$^{25}$=any amino acid; X$^{29}$=I, L, V or M; X$^{30}$=I, L, V or M; X$^{36}$=I, L, V or M; X$^{37}$=T, I, L, V or M; X$^{39}$=K or R; X$^{41}$=any amino acid; X$^{42}$=A, I, L, V or M; X$^{50}$=I, L, V or M; X$^{52}$=S or A; and X$^{55}$=any amino acid.

NF-YC8 (AT5G27910.1 or G1836) Clade Polypeptides

TABLE 4

Conserved 'CBF/NF-Y domain' of NF-YC8 and closely related sequences

| Col. 1 SEQ ID NO: | Col. 2 Species Identifier | Col. 3 Percent identity of polypeptide in Col. 1 to NF-YC8 | Col. 4 CBF/NF-Y domain in amino acid coordinates | Col. 5 Conserved CBF/NF-Y domain | Col. 6 SEQ ID NO: of CBF/NF-Y domain | Col. 7 Percent identity of the CBF/NF-Y domain in Col. 5 to the CBF/NF-Y domain of NF-YC8 |
|---|---|---|---|---|---|---|
| 106 | At/NF-YC8 (AT5G27910.1) | 100% (187/187) | 35-99 | HDLPITRIKKIMKYDPDV TMIASEAPILLSKACEMF IMDLTMRSWLHAQESKRV TLQKSNVDAAV | 381 | 100% (65/65) |
| 108 | At/AT5G50490.1 | 66% (129/194) | 35-99 | HEFPISRIKRIMKFDPDV SMIAAEAPNLLSKACEMF VMDLTMRSWLHAQESNRL TIRKSDVDAVV | 382 | 76% (50/65) |
| 110 | At/AT5G50480.1 | 49% (101/204) | 53-117 | RQLPLARIKKIMKADPDV HMVSAEAPIIFAKACEMF IVDLTMRSWLKAEENKRH TLQKSDISNAV | 383 | 67% (44/65) |
| 112 | Sl/Solyc03g111 470.1.1 | 53% (49/91) | 74-138 | HSLPIFRIKKIMKSDKEV RMISAESPILLDKACELF IQELTHRSWLKAQECQRR TLKKIDFFTTE | 384 | 60% (39/65) |
| 114 | Sl/Solyc03g111 460.1.1 | 49% (54/109) | 64-128 | HSLPISRIKKIMKSDKEV RMISAESPILLAKACELF IQELTHRSWLKAQECQRQ TLKKIDLFTVL | 385 | 60% (39/65) |
| 116 | At/AT5G50470.1 | 43% (94/218) | 62-132 | HAFPLTRIKKIMKSNPEV NMVTAEAPVLISKACEML ILDLTMRSWLHTVEGGRQ TLKRSDTLTRSDISAAT | 386 | 56% (40/71) |
| 118 | Sl/Solyc03g110 850.1.1 | 52% (59/112) | 53-118 | NLLPRIHRIKKIMKTDKD VRMIATESPVLLAKACEL FIQELTLRSWFKAEENHR RILKKDDVTDVI | 387 | 54% (36/66) |
| 120 | Sl/Solyc03g110 840.1.1 | 48% (57/117) | 52-117 | RLLLPPTRIKKIMKKNED VRMVAGESPVLLAKACEL FIQDLTLRSSIHAQENHR RILKKDDLTDVI | 388 | 54% (36/66) |
| 122 | Sl/Solyc11g016 920.1.1 | 52% (56/107) | 53-118 | NLLPSINRIKKIMKTDKD VRMIATESPVLLAKACEL FIQELTLRSWFKTEKNHR RILKKDDVTDVI | 389 | 51% (34/66) |
| 124 | Sl/Solyc02g021 330.1.1 | 51% (50/98) | 54-119 | NHLLPPNLIKKLMKTDED DQMIAAESPVLLAKTCEL FIQELTLRSWLNAQEKHQ HILKKDDVTDVI | 390 | 50% (33/66) |
| 126 | Sl/Solyc00g107 050.1.1 | 46% (47/102) | 55-120 | NLLVSPNRIKNIMKTNKD VRRITSESPVLLAKACDF FIQELTLRSWLNAQENHR RILKKDVTDVI | 391 | 50% (33/66) |
| 128 | Sl/Solyc03g111 450.1.1 | 36% (64/176) | 102-166 | HHFPISRIKRIIKSENNA IKLSAETPILFSKACELF VLELTLRSWFHAQQNNRG SLKKTDFAAAI | 392 | 47% (31/65) |
| 130 | Gm/Glyma02g 09860.1 | 43% (35/80) | 4-69 | QQKLPLARIRRMMKSEPG VQMISSEIPMLMSKACEI FIQELTFRAWMHAEKNNK SIVQPCDVAKVI | 393 | 42% (28/66) |

TABLE 4-continued

Conserved 'CBF/NF-Y domain' of NF-YC8 and closely related sequences

| Col. 1 SEQ ID NO: | Col. 2 Species Identifier | Col. 3 Percent identity of polypeptide in Col. 1 to NF-YC8 | Col. 4 CBF/NF-Y domain in amino acid coordinates | Col. 5 Conserved CBF/NF-Y domain | Col. 6 SEQ ID NO: of CBF/NF-Y domain | Col. 7 Percent identity of the CBF/NF-Y domain in Col. 5 to the CBF/NF-Y domain of NF-YC8 |
|---|---|---|---|---|---|---|
| 132 | Os/LOC_Os01 g24460.1 | 33% (40/118) | 42-106 | HMIPMARLKKIVSSQKGN MMMTFDMPAFLSKMCELF VQELAARAWACAQSHNRC IILDMDIAEAV | 394 | 33% (22/65) |
| 134 | Os/LOC_Os01 g01290.1 | 36% (39/106) | 42-106 | HAIPMARLKKIASSQKGN MMMSFDMPAFLSKMCELF VQELAVRAWASAQSHNRC IILDTDIAEAI | 395 | 32% (21/65) |
| 136 | Os/LOC_Os01 g39850.1 | 36% (38/104) | 42-106 | HAIPMARLKKIVSSQKGN MMMTFDMPAFLSKMCELF VQELAVRAWASAQSHNRC IILDTDIAKAI | 396 | 32% (21/65) |

These functionally-related and/or closely-related NF-YC8 clade polypeptides may be identified by a consensus CBF/NF-Y domain sequence, SEQ ID NO: 513: $X^1X^2X^3X^4X^5X^6X^7X^8X^9X^{10}X^{11}X^{12}X^{13}X^{14}X^{15}X^{16}X^{17}X^{18}X^{19}X^{20}X^{21}X^{22}X^{23}X^{24}X^{25}X^{26}PX^{28}X^{29}X^{30}X^{31}KX^{33}X^{35}X^{36}X^{37}X^{38}X^{39}X^{40}LX^{42}X^{43}RX^{45}X^{46}X^{47}X^{48}X^{49}X^{50}X^{51}X^{52}X^{53}X^{54}X^{55}X^{56}X^{57}X^{58}X^{59}X^{60}X^{61}X^{62}X^{63}X^{64}X^{65}X^{66}X^{67}X^{68}X^{69}X^{70}X^{71}X^{72}$
where $X^1$=H, Q, N or R; $X^2$=any amino acid; $X^3$=any amino acid; $X^4$=any amino acid or absent; $X^5$=any amino acid; $X^6$=any amino acid; $X^7$=any amino acid; $X^8$=any amino acid; $X^9$=I, L, V or M; $X^{10}$=K or R; $X^{11}$=any amino acid; $X^{12}$=I, L, V or M; $X^{13}$=A, I, L, M or V; $X^{14}$=any amino acid; $X^{15}$=any amino acid; $X^{16}$=D, E, N or Q; $X^{17}$=any amino acid; $X^{18}$=any amino acid; $X^{19}$=any amino acid; $X^{20}$=any amino acid; $X^{21}$=any amino acid; $X^{22}$=I, L, V or M; $X^{23}$=S, A or T; $X^{24}$=any amino acid; $X^{25}$=E or D; $X^{26}$=any amino acid; $X^{28}$=any amino acid; $X^{29}$=F, I, L, V or M; $X^{30}$=F, I, L, V or M; $X^{31}$=any amino acid; $X^{33}$=A, T, I, L, V or M; $X^{35}$=E or D; $X^{36}$=F, I, L, V or M; $X^{37}$=F, I, L, V or M; $X^{38}$=I, L, V or M; $X^{39}$=any amino acid; $X^{40}$=E or D; $X^{42}$=A or T; $X^{43}$=any amino acid; $X^{45}$=A or S; $X^{46}$=any amino acid; $X^{47}$=A, F, I, L, V or M; $X^{48}$=any amino acid; $X^{49}$=A or T; $X^{50}$=any amino acid; $X^{51}$=any amino acid; $X^{52}$=any amino acid; $X^{53}$=any amino acid; $X^{54}$=K, Q or R; $X^{55}$=any amino acid; $X^{56}$=any amino acid; $X^{57}$=I, L, V or M; $X^{58}$=any amino acid; $X^{59}$=R or absent; $X^{60}$=S or absent; $X^{61}$=D or absent; $X^{62}$=T or absent; $X^{63}$=L or absent; $X^{64}$=T or absent; $X^{65}$=any amino acid; $X^{66}$=any amino acid; $X^{67}$=N or D; $X^{68}$=F, I, L, V or M; $X^{69}$=any amino acid; $X^{70}$=any amino acid; $X^{71}$=A, T, I, L, V or M; and $X^{72}$=any amino acid.

GATA4 (AT3G60530.1 or G342) Clade Polypeptides

TABLE 5

Conserved 'unknown domain' of GATA4 and closely related sequences

| Col. 1 SEQ ID NO: | Col. 2 Species/ Identifier | Col. 3 Percent identity of polypeptide in Col. 1 to GATA4 | Col. 4 Domain in amino acid coordinates | Col. 5 Conserved domain | Col. 6 SEQ ID NO: of domain | Col. 7 Percent identity of the domain in Col. 5 to the domain of GATA4 |
|---|---|---|---|---|---|---|
| 138 | At/GATA4 (AT3G60530.1) | 100% (240/240) | 70-86 | PSDDAAHLEWLSRFVDD | 397 | 100% (17/17) |
| 140 | At/AT2G45050.1 | 68% (171/249) | 72-88 | PSDDAAHLEWLSQFVDD | 398 | 94% (16/17) |
| 142 | Vv/GSVIVT01 018180001 | 61% (141/230) | 72-88 | PSDDVAELEWLSNFVDD | 399 | 82% (14/17) |
| 144 | Cc/clementine0. 9_018978m | 57% (134/233) | 76-92 | PSDDVAELEWLSQFVDD | 400 | 82% (14/17) |
| 146 | Sl/Solyc01g090 760.2.1 | 56% (143/251) | 76-92 | PSDDVAELEWLSNFVED | 401 | 76% (13/17) |
| 148 | Gm/Glyma07g 14750.1 | 56% (100/177) | 57-73 | PTDEAAELEWLSQFVDD | 402 | 76% (13/17) |
| 150 | Sl/Solyc10g018 560.1.1 | 53% (130/243) | 73-89 | PSDDVAELEWLSNFVED | 403 | 76% (13/17) |

TABLE 5-continued

Conserved 'unknown domain' of GATA4 and closely related sequences

| Col. 1 SEQ ID NO: | Col. 2 Species/ Identifier | Col. 3 Percent identity of polypeptide in Col. 1 to GATA4 | Col. 4 Domain in amino acid coordinates | Col. 5 Conserved domain | Col. 6 SEQ ID NO: of domain | Col. 7 Percent identity of the domain in Col. 5 to the domain of GATA4 |
|---|---|---|---|---|---|---|
| 152 | Zm/GRMZM2 G113098_T01 | 50% (107/212) | 131-147 | PSEEAAELEWLSKFVDD | 404 | 76% (13/17) |
| 154 | Os/LOC_Os10 g40810.1 | 49% (109/220) | 138-154 | PIEDAAELEWLSKFVDD | 405 | 76% (13/17) |
| 156 | Si/Si036273m | 48% (106/218) | 124-140 | PSEEAAELEWLSKFVDD | 406 | 76% (13/17) |
| 158 | Zm/GRMZM2 G110295_T01 | 46% (105/224) | 130-146 | PSEEAAELEWLSKFVDD | 407 | 76% (13/17) |
| 160 | Bd/Bradi3g332 00.1 | 46% (102/219) | 123-139 | PSEEAAELEWLSKFVDD | 408 | 76% (13/17) |
| 162 | Pt/POPTR_001 4s05760.1 | 57% (138/238) | 79-95 | PTDDVAELEWLSQFVED | 409 | 70% (12/17) |
| 164 | Pt/POPTR_000 2s14380.1 | 56% (131/233) | 77-93 | PSDDVAELEWLSQFMED | 410 | 70% (12/17) |
| 166 | Gm/Glyma03g 27250.1 | 53% (95/178) | 59-75 | PSDEAVELEWLSQFVND | 411 | 70% (12/17) |
| 168 | Bd/Bradi1g785 40.1 | 52% (103/195) | 133-149 | PREEAAELEWLSNFVDD | 412 | 70% (12/17) |
| 170 | Zm/GRMZM2 G101058_T01 | 47% (107/225) | 130-146 | PILEAAELEWLSKFVDD | 413 | 70% (12/17) |
| 172 | Cc/clementine0. 9_015262m | 44% (116/260) | 112-128 | PYDDLAELEWLSNFVED | 414 | 70% (12/17) |

These functionally-related and/or closely-related GATA4 clade polypeptides may be identified by a consensus domain sequence, SEQ ID NO: 514:
$PX^2X^3X^4X^5X^6X^7LEWLSX^{13}FX^{15}X^{16}$
where $X^2$=any amino acid; $X^3$=D or E; $X^4$=D or E; $X^5$=A, I, L, V or M; $X^6$=A, I, L, V or M; $X^7$=any amino acid; $X^{13}$=Q, N, K or R; $X^{15}$=I, L, V or M; and $X^{16}$=D, N or E.

TABLE 6

Conserved 'GATA-Zinc finger domain' of GATA4 and closely related sequences

| Col. 1 SEQ ID NO: | Col. 2 Species/ Identifier | Col. 3 Percent identity of polypeptide in Col. 1 to GATA4 | Col. 4 GATA-Zinc finger domain in amino acid coordinates | Col. 5 Conserved GATA-Zinc finger domain | Col. 6 SEQ ID NO: of GATA-Zinc finger domain | Col. 7 Percent identity of the GATA-Zinc finger domain in Col. 5 to the GATA-Zinc finger domain of GATA4 |
|---|---|---|---|---|---|---|
| 138 | At/GATA4 (AT3G60530.1) | 100% (240/240) | 158-226 | RRCTHCASEKTPQWRTGPL GPKTLCNACGVRYKSGRLV PEYRPASSPTFVLTQHSNS HRKVMELRRQKE | 415 | 100% (68/68) |
| 140 | At/AT2G45050.1 | 68% (171/249) | 179-247 | RRCTHCASEKTPQWRTGPL GPKTLCNACGVRFKSGRLV PEYRPASSPTFVLTQHSNS HRKVMELRRQKE | 416 | 98% (67/68) |
| 144 | Cc/clementine0 .9_018978m | 57% (134/233) | 165-233 | RRCTHCASEKTPQWRTGPL GPKTLCNACGVRYKSGRLV PEYRPASSPTFVLTQHSNS HRKVLELRRQKE | 417 | 98% (67/68) |

TABLE 6-continued

Conserved 'GATA-Zinc finger domain' of GATA4 and closely related sequences

| Col. 1 SEQ ID NO: | Col. 2 Species/ Identifier | Col. 3 Percent identity of polypeptide in Col. 1 to GATA4 | Col. 4 GATA-Zinc finger domain in amino acid coordinates | Col. 5 Conserved GATA-Zinc finger domain | Col. 6 SEQ ID NO: of GATA-Zinc finger domain | Col. 7 Percent identity of the GATA-Zinc finger domain in Col. 5 to the GATA-Zinc finger domain of GATA4 |
|---|---|---|---|---|---|---|
| 146 | Sl/Solyc01g090760.2.1 | 56% (143/251) | 165-233 | RRCTHCASEKTPQWRTGPL GPKTLCNACGVRYKSGRLV PEYRPAASPTFVLTQHSNS HRKVMELRRQKE | 418 | 98% (67/68) |
| 142 | Vv/GSVIVT01018180001 | 61% (141/230) | 155-223 | RKCTHCASEKTPQWRTGPL GPKTLCNACGVRYKSGRLV PEYRPAASPTFVLTQHSNS HRKVMELRRQKE | 419 | 97% (66/68) |
| 164 | Pt/POPTR_0002s14380.1 | 56% (131/233) | 161-229 | RRCTHCASEKTPQWRTGPL GPKTLCNACGVRYKSGRLV PEYRPAASPTFVLTQHSNS HRKVLELRRQKE | 420 | 97% (66/68) |
| 150 | Sl/Solyc10g018560.1.1 | 53% (130/243) | 170-238 | RKCTHCASEKTPQWRTGPL GPKTLCNACGVRYKSGRLV PEYRPAASPTFVLTQHSNS HRKVMELRRQKE | 421 | 97% (66/68) |
| 168 | Bd/Bradi1g78540.1 | 52% (103/195) | 254-322 | RRCTHCASEKTPQWRTGPL GPKTLCNACGVRYKSGRLV PEYRPAASPTFVLTQHSNS HRKVMELRRQNE | 422 | 97% (66/68) |
| 152 | Zm/GRMZM2G113098_T01 | 50% (107/212) | 259-327 | RRCTHCASEKTPQWRTGPL GPKTLCNACGVRFKSGRLV PEYRPAASPTFVLTQHSNS HRKVMELRRQKE | 423 | 97% (66/68) |
| 158 | Zm/GRMZM2G110295_T01 | 46% (105/224) | 273-341 | RRCTHCASETTPQWRTGPL GPKTLCNACGVRFKSGRLV PEYRPASSPTFVLTQHSNS HRKVMELRRQKE | 424 | 97% (66/68) |
| 162 | Pt/POPTR_0014s05760.1 | 57% (138/238) | 163-231 | RRCTHCASEKTPQWRTGPL GPKTLCNACGVRYKSGRLV PEYRPAASPTFVLTRHSNS HRKVLELRRQKE | 425 | 95% (65/68) |
| 154 | Os/LOC_Os10g40810.1 | 49% (109/220) | 276-344 | RRCTHCASEKTPQWRTGPL GPKTLCNACGVRFKSGRLM PEYRPAASPTFVLTQHSNS HRKVMELRRQKE | 426 | 95% (65/68) |
| 156 | Si/Si036273m | 48% (106/218) | 260-328 | RRCTHCASEKTPQWRTGPL GPKTLCNACGVRFKSGRLM PEYRPAASPTFVLTQHSNS HRKVMELRRQKE | 427 | 95% (65/68) |
| 170 | Zm/GRMZM2G101058_T01 | 47% (107/225) | 273-341 | RRCTHCASEKTPQWRTRGP LGPKTLCNACGVRFKSGRL MPEYRPAASPTFVLTQHSN SHRKVMELRRQKE | 428 | 95% (65/68) |
| 160 | Bd/Bradi3g33200.1 | 46% (102/219) | 260-328 | RRCTHCASEKTPQWRTGPL GPKTLCNACGVRFKSGRLV PEYRPAASPTFLLTQHSNS HRKVMELRRQKE | 429 | 95% (65/68) |
| 148 | Gm/Glyma07g14750.1 | 56% (100/177) | 141-209 | RRCSHCASEKTPQWRAGPL GPKTLCNACGVRFKSGRLV PEYRPAASPTFVLTQHSNS HRKVMELRRQKE | 430 | 94% (64/68) |

TABLE 6-continued

Conserved 'GATA-Zinc finger domain' of GATA4 and closely related sequences

| Col. 1 SEQ ID NO: | Col. 2 Species/ Identifier | Col. 3 Percent identity of polypeptide in Col. 1 to GATA4 | Col. 4 GATA-Zinc finger domain in amino acid coordinates | Col. 5 Conserved GATA-Zinc finger domain | Col. 6 SEQ ID NO: of GATA-Zinc finger domain | Col. 7 Percent identity of the GATA-Zinc finger domain in Col. 5 to the GATA-Zinc finger domain of GATA4 |
|---|---|---|---|---|---|---|
| 166 | Gm/Glyma03g 27250.1 | 53% (95/178) | 137-205 | RRCSHCATDKTPQWRTGPL GPKTLCNACGVRFKSGRLV PEYRPAASPTFVMTQHSNS HRKVMELRRQKE | 431 | 91% (62/68) |
| 172 | Cc/clementine0 .9_015262m | 44% | 227-295 | RKCLHCASEKTPQWRTGPM GPKTLCNACGVRYKSGRLV PEYRPAASPTFVSAKHSN SHRKVMELRRQKE | 432 | 89% (61/68) |

These functionally-related and/or closely-related GATA4 clade polypeptides may be identified by a consensus GATA-Zinc finger domain sequence, SEQ ID NO: 515: RX$^2$CX$^4$HCAX$^8$X$^9$X$^{10}$TPQWRX$^{16}$GPX$^{19}$GPKTLCNAC GVRX$^{32}$KSGRLX$^{38}$PEYRPAX$^{45}$SPTFX$^{50}$X$^{51}$X$^{52}$X$^{53}$HS NSHRKVX$^{62}$ELRRQX$^{68}$E where X$^2$=K or R; X$^4$=any amino acid; X$^8$=S or T; X$^9$=D or E; X$^{10}$=any amino acid; X$^{16}$=A or T; X$^{19}$=I, L, V or M; X$^{32}$=F or Y; X$^{38}$=I, L, V or M; X$^{45}$=A or S; X$^{50}$=I, L, V or M; X$^{51}$=any amino acid; X$^{52}$=A or T; X$^{53}$=Q, K or R; X$^{62}$=I, L, V or M; and X$^{68}$=N or K.

WUS (AT2G17950.1 or G1540) Clade Polypeptides

TABLE 7

Conserved 'Homeodomain' of WUS and closely related sequences

| Col. 1 SEQ ID NO: | Col. 2 Species/ Identifier | Col. 3 Percent identity of polypeptide in Col. 1 to WUS | Col. 4 Homeo- domain in amino acid coordinates | Col. 5 Conserved homeodomain | Col. 6 SEQ ID NO: of homeo- domain | Col. 7 Percent identity of the homeodomain in Col. 5 to the homeodomain of WUS |
|---|---|---|---|---|---|---|
| 174 | At/WUS (AT2G17950.1) | 100% (292/292) | 35-99 | TSTRWTPTIEQIKILKELY YNNAIRSPTADQIQKITAR LRQFGKIEGKNVFYWFQNH KARERQKK | 433 | 100% (65/65) |
| 176 | Eg/Eucgr.J0242 9.1 | 71% (66/92) | 41-105 | SSTRWTPTTDQIRILKDLY YNYGVRSPTADQIQRISAR LRQYGKIEGKNVFYWFQNH KARERQKK | 434 | 84% (55/65) |
| 178 | Gm/Glyma01g 37190.1 | 43% (95/216) | 35-99 | SSTRWTPTNDQIRILKELY YNNGIRSPSAEQIQRISAR LRQYGKIEGKNVFYWFQNH KARERQKK | 435 | 84% (55/65) |
| 180 | Gm/Glyma11g 08090.1 | 80% (58/72) | 31-95 | SSTRWTPTNDQIRILKDLY YNNGIRSPSAEQIQRISAR LRQYGKIEGKNVFYWFQNH KARERQKK | 436 | 83% (54/65) |
| 182 | Vv/GSVIVT01 018787001 | 43% (108/248) | 34-98 | SSTRWTPTTDQIRILKDLY YNNGVRSPSAEQIQRISAR LRQYGKIEGKNVFYWFQNH KARERQKK | 437 | 83% (54/65) |
| 184 | Cc/clementine0 .9_033636m | 41% (122/294) | 30-94 | TCPRWTPTTDQIRILKELY YNNGVRSPTAEQIQKISAR LRQYGKIEGKNVFYWFQNY KARERLKK | 438 | 83% (54/65) |
| 186 | Sl/Solyc02g083 950.2.1 | 37% (105/283) | 23-87 | SSSRWTPTSDQIRILKDLY YNNGVRSPTAEQIQRISAK LRQYGKIEGKNVFYWFQNH KARERQKK | 439 | 80% (52/65) |

TABLE 7-continued

Conserved 'Homeodomain' of WUS and closely related sequences

| Col. 1 SEQ ID NO: | Col. 2 Species/ Identifier | Col. 3 Percent identity of polypeptide in Col. 1 to WUS | Col. 4 Homeo- domain in amino acid coordinates | Col. 5 Conserved homeodomain | Col. 6 SEQ ID NO: of homeo- domain | Col. 7 Percent identity of the homeodomain in Col. 5 to the homeodomain of WUS |
|---|---|---|---|---|---|---|
| 188 | Os/LOC_Os04 g56780.1 | 68% (56/82) | 32-96 | SGTRWTPTTEQIKILRELY YSCGIRSPNSEQIQRIAAM LRQYGRIEGKNVFYWFQNH KARERQKK | 440 | 78% (51/65) |
| 190 | Pt/POPTR_000 5s11680.1 | 41% (102/246) | 31-95 | TSTRWTPTTDQIRILKELY YIKGVRSPNGAEIQQISAR LRKYGKIEGKNVFYWFQNH KARERQKK | 441 | 78% (51/65) |
| 192 | Pt/POPTR_000 5s11680.2 | 40% (99/246) | 31-95 | TSTRWTPTTDQIRILKELY YIKGVRSPNGAEIQQISAR LRKYGKIEGKNVFYWFQNH KARERQKK | 442 | 78% (51/65) |
| 194 | Si/Si024219m | 64% (55/85) | 31-95 | SGSRWTPTPEQIRILKELY YGCGIRSPNSEQIQRITAM LRQHGKIEGKNVFYWFQNH KARERQKR | 443 | 76% (50/65) |
| 196 | Zm/GRMZM2 G047448_T01 | 63% (55/86) | 37-101 | SGSRWTPTPEQIRILKELY YGCGIRSPNSEQIQRITAM LRQHGKIEGKNVFYWFQNH KARERQKR | 444 | 76% (50/65) |
| 198 | Pt/POPTR_000 7s14130.1 | 41% (102/244) | 25-89 | TSTRWNPTTDQIRILKELY YIKGVRSPNGAEIQQISAR LRKYGKIEGKNVFYWFQNH KARERQKK | 445 | 76% (50/65) |
| 200 | Pt/POPTR_000 7s14130.2 | 40% (98/244) | 25-89 | TSTRWNPTTDQIRILKELY YIKGVRSPNGAEIQQISAR LRKYGKIEGKNVFYWFQNH KARERQKK | 446 | 76% (50/65) |
| 202 | Zm/GRMZM2 G028622_T01 | 65% (53/81) | 28-92 | SGSRWTPTPEQIRMLKELY YGCGIRSPSSEQIQRITAM LRQHGKIEGKNVFYWFQNH KARERQKR | 447 | 75% (49/65) |

These functionally-related and/or closely-related WUS clade polypeptides may be identified by a consensus Homeodomain sequence, SEQ ID NO: 516:
$X^1X^2X^3RWX^6PTX^9X^{10}QIX^{13}X^{14}LX^{16}X^{17}LYYX^{21}X^{22}X^{23}X^{24}RSPX^{28}X^{29}X^{30}X^{31}IQX^{34}IX^{36}AX^{38}LRX^{41}X^{42}GX^{44}IE$
$GKNVFYWFQNX^{57}KARERA^{63}KX^{65}$
where $X^1$=S or T; $X^2$=C, G or S; $X^3$=any amino acid; $X^6$=any amino acid; $X^9$=any amino acid; $X^{10}$=D or E; $X^{13}$=K or R; $X^{14}$=I, L, V or M; $X^{16}$=R or K; $X^{17}$=D or E; $X^{21}$=any amino acid; $X^{22}$=any amino acid; $X^{23}$=A or G; $X^{24}$=I, L, V or M; $X^{28}$=any amino acid; $X^{29}$=S, A or G; $X^{30}$=any amino acid; $X^{31}$=Q or E; $X^{34}$=Q, R or K; $X^{36}$=A, S or T; $X^{38}$=any amino acid; $X^{41}$=Q or K; $X^{42}$=any amino acid; $X^{44}$=R or K; $X^{57}$=any amino acid; $X^{63}$=any amino acid; and $X^{65}$=K or R.

ERF054 (AT4G28140.1 or G1845) Clade Polypeptides

TABLE 8

Conserved 'AP2 domain' of ERF054 and closely related sequences

| Col. 1 SEQ ID NO: | Col. 2 Species/ Identifier | Col. 3 Percent identity to polypeptide in Col. 1 to ERF054 | Col. 4 AP2 domain in amino acid coordinates | Col. 5 Conserved AP2 domain | Col. 6 SEQ ID NO: of AP2 domain | Col. 7 Percent identity of the AP2 domain in Col. 5 to the AP2 domain of ERF054 |
|---|---|---|---|---|---|---|
| 204 | At/ERF054 (AT4G28140.1) | 100% (292/292) | 141-201 | KLYRGVRQRQWGKWVAEI RKPRSRARLWLGTFDTAE EAAMAYDRQAFKLRGHSA TLNFPEH | 448 | 100% (61/61) |

TABLE 8-continued

Conserved 'AP2 domain' of ERF054 and closely related sequences

| Col. 1 SEQ ID NO: | Col. 2 Species/ Identifier | Col. 3 Percent identity to polypeptide in Col. 1 to ERF054 | Col. 4 AP2 doamin in amino acid coordinates | Col. 5 Conserved AP2 domain | Col. 6 SEQ ID NO: of AP2 domain | Col. 7 Percent identity of the AP2 domain in Col. 5 to the AP2 domain of ERF054 |
|---|---|---|---|---|---|---|
| 206 | At/AT2G20880.1 | 50% | 185-245 | KLYRGVRQRHWGKWVAEI RKPRNRTRLWLGTFDTAE EAAMAYDREAFKLRGETA RLNFPEL | 449 | 86% (53/61) |
| 208 | Sl/Solyc07g054 220.1.1 | 42% (140/330) | 179-239 | KLYRGVRQRHWGKWVAEI RLPRNRTRLWLGTFDTAE DAAMAYDREAYKLRGDNA KLNFPEH | 450 | 83% (51/61) |
| 210 | Gm/Glyma06g 45010.1 | 41% (134/320) | 206-266 | KLYRGVRQRHWGKWVAEI RLPRNRTRLWLGTFDTAE DAAMAYDREAFKLRGENA KLNFPEL | 451 | 83% (51/61) |
| 212 | Gm/Glyma12g 12270.1 | 41% (124/298) | 188-248 | KLYRGVRQRHWGKWVAEI RLPRNRTRLWLGTFDTAE DAAMAYDREAFKLRGENA KLNFPEL | 452 | 83% (51/61) |
| 214 | Gm/Glyma12g 33020.1 | 38% (124/325) | 206-266 | KLYRGVRQRHWGKWVAEI RLPRNRTRLWLGTFDTAE DAAMAYDREAFKLRGENA RLNFPEL | 453 | 83% (51/61) |
| 216 | Zm/GRMZM2 G300924_T01 | 59% (63/106) | 211-271 | KLYRGVRQRHWGKWVAEI RLPRNRTRLWLGTFDTAE DAAMAYDREAFKLRGDNA RLNFPDL | 454 | 81% (50/61) |
| 218 | Si/Si019997m | 62% (63/101) | 217-277 | KLYRGVRQRHWGKWVAEI RLPRNRTRLWLGTFDTAE DAAMAYDREAFKLRGENA KLNFPDL | 455 | 81% (50/61) |
| 220 | Bd/Bradi3g498 10.1 | 54% (78/142) | 182-242 | KLYRGVRQRHWGKWVAEI RLPRNRTRLWLGTFDTAE DAAMAYDREAFKLRGENA RLNFPDL | 456 | 81% (50/61) |
| 222 | Zm/GRMZM2 G139765_T01 | 44% (94/213) | 206-266 | KLYRGVRQRHWGKWVAEI RLPRNRTRLWLGTFDTAE DAAMAYDREAFKLRGENA KLNFPDL | 457 | 81% (50/61) |
| 224 | Eg/Eucgr.K009 61.1 | 39% (149/380) | 236-296 | KLYRGVRQRHWGKWVAEI RLPRNRTRLWLGTFDTAE DAALAYDREAFKLRGENA RLNFPEL | 458 | 81% (50/61) |
| 226 | Pt/POPTR_001 3s13920.1 | 39% (130/329) | 230-290 | KLYRGVRQRHWGKWVAEI RLPRNRTRLWLGTFDTAE DAALAYDREAFKLRGENA RLNFPEL | 459 | 81% (50/61) |
| 228 | Gm/Glyma13g 37450.1 | 38% (108/283) | 147-207 | KLYRGVRQRHWGKWVAEI RLPRNRTRLWLGTFDTAE DAAMAYDREAFKQRGENA RLNFPEL | 460 | 81% (50/61) |
| 230 | Os/LOC_Os04 g44670.1 | 34% (114/327) | 213-273 | KLYRGVRQRHWGKWVAEI RLPRNRTRLWLGTFDTAE DAAMAYDREAFKLRGENA RLNFPDR | 461 | 81% (50/61) |
| 232 | Os/LOC_Os02 g42585.1 | 34% (115/336) | 224-284 | KLYRGVRQRHWGKWVAEI RLPRNRTRLWLGTFDTAE DAAMAYDREAFKLRGENA RLNFPDL | 462 | 81% (50/61) |

TABLE 8-continued

Conserved 'AP2 domain' of ERF054 and closely related sequences

| Col. 1 SEQ ID NO: | Col. 2 Species/ Identifier | Col. 3 Percent identity to polypeptide in Col. 1 to ERF054 | Col. 4 AP2 doamin in amino acid coordinates | Col. 5 Conserved AP2 domain | Col. 6 SEQ ID NO: of AP2 domain | Col. 7 Percent identity of the AP2 domain in Col. 5 to the AP2 domain of ERF054 |
|---|---|---|---|---|---|---|
| 234 | Bd/Bradi5g164 50.1 | 53% (72/135) | 217-277 | KLYRGVRQRHWGKWVAEI RLPRNRTRLWLGTFDSAE DAAMAYDREAFKLRGENA RLNFPDR | 463 | 80% (49/61) |
| 236 | Pt/POPTR_001 9s13330.1 | 40% (146/359) | 230-290 | KLYRGVRQRHWGKWVAEI RLPRNRTRLWLGTFDNAE DAALAYDREAFKLRGENA KLNFPEL | 464 | 80% (49/61) |
| | Zm/GRMZM2 G040664_T01 | 40% (101/251) | 173-233 | KLYRGVRQRHWGKWVAEI RLPRDRTRLWLGTFDSAE DAAMAYDREAFKLRGENA RLNFPDR | 465 | 80% (49/61) |
| 240 | Cc/clementine0. 9_009464m | 39% (142/356) | 218-278 | KLYRGVRQRHWGKWVAEI RLPRNRTRLWLGTFDRAE DAALAYDREAFKLRGENA RLNFPEL | 466 | 80% (49/61) |
| 242 | Zm/GRMZM2 G026926_T01 | 39% (108/275) | 212-272 | KLYRGVRQRHWGKWVAEI RLPRNRTRLWLGTFDSAE DAAMAYDREAFKLRGENA RLNFPDR | 467 | 80% (49/61) |
| 244 | Si/Si012169m | 37% (120/324) | 212-272 | KLYRGVRQRHWGKWVAEI RLPRNRTRLWLGTFDSAE DAAMAYDREAFKLRGENA RLNFPDR | 468 | 80% (49/61) |

These functionally-related and/or closely-related ERF054 clade polypeptides may be identified by a consensus AP2 sequence, SEQ ID NO: 517:
KLYRGVRQRX$^{10}$WGKWVAEIRX$^{20}$PRX$^{23}$RX$^{25}$RLWG TFDX$^{34}$AEX$^{37}$AAX$^{40}$AYDRX$^{45}$AX$^{47}$KX$^{49}$RGX$^{52}$X$^{53}$A X$^{55}$LNFPX$^{60}$X$^{61}$ where X$^{10}$=H or Q; X$^{20}$=any amino acid; X$^{23}$=any amino acid; X$^{25}$=A or T; X$^{34}$=any amino acid; X$^{37}$=D or E; X$^{40}$=I, L, V or M; X$^{45}$=Q or E; X$^{47}$=F or Y; X$^{49}$=any amino acid; X$^{52}$=any amino acid; X$^{53}$=any amino acid; X$^{55}$=any amino acid; X$^{60}$=D or E; and X$^{61}$=any amino acid.

AMS (G1135) Clade Polypeptides

TABLE 9

Conserved 'bHLH domain' of AMS and closely related sequences

| Col. 1 SEQ ID NO: | Col. 2 Species/ Identifier | Col. 3 Percent identity of polypeptide in Col. 1 to AMS | Col. 4 bHLH domain in amino acid coordinates | Col. 5 Conserved bHLH domain | Col. 6 SEQ ID NO: bHLH domain | Col. 7 Percent identity of the bHLH domain in Col. 5 to the bHLH domain of AMS |
|---|---|---|---|---|---|---|
| 246 | At/G1135 | 100% (571/571) | 373-423 | KNLMAERRRRKKLN DRLYALRSLVPRIT KLDRASILGDAINY VKELQNEAK | 469 | 100% (51/51) |
| 248 | At/AMS (AT2G16910.1) | 100% (571/571) | 314-364 | KNLMAERRRRKKLN DRLYALRSLVPRIT KLDRASILGDAINY VKELQNEAK | 470 | 100% (51/51) |
| 250 | Pt/POPTR_000 9s13860.1 | 48% (280/573) | 324-374 | KNLVAERKRRKKLN DRLYALRSLVPNIS KLDRASILGDAIEF VKELQKEAK | 471 | 86% (44/51) |

TABLE 9-continued

Conserved 'bHLH domain' of AMS and closely related sequences

| Col. 1 SEQ ID NO: | Col. 2 Species/ Identifier | Col. 3 Percent identity of polypeptide in Col. 1 to AMS | Col. 4 bHLH domain in amino acid coordinates | Col. 5 Conserved bHLH domain | Col. 6 SEQ ID NO: bHLH domain | Col. 7 Percent identity of the bHLH domain in Col. 5 to the bHLH domain of AMS |
|---|---|---|---|---|---|---|
| 252 | Vv/GSVIVT01 013720001 | 49% (273/547) | 308-358 | KNLVAERRRRKKLN DRLYALRALVPKIS KLDRASILGDAIEF VKELQKQAK | 472 | 84% (43/51) |
| 254 | Vv/GSVIVT01 024008001 | 48% (272/561) | 331-381 | KNIDAERRRRKKLN DRLYALRSLVPKIS KLDRASILGDAIEF VKELQKQAK | 473 | 84% (43/51) |
| 256 | Gm/Glyma10g 42830.1 | 46% (258/553) | 334-384 | KNLVAERKRRKKLN DRLYNLRSLVPRIS KLDRASILGDAIEY VKDLQKQVK | 474 | 82% (42/51) |
| 258 | Gm/Glyma20g 24170.1 | 45% (247/542) | 292-342 | KNLVAERKRRKKLN DRLYNLRSLVPRIS KLDRASILGDAIEY VKDLQKQVK | 475 | 82% (42/51) |
| 260 | Eg/Eucgr.G017 83.1 | 43% (245/564) | 308-358 | KNLQAERRRRKKLN DRLYNLRSLVPKIS KLDRASILGDAIEY IMELQKQAK | 476 | 82% (42/51) |
| 262 | Cc/clementine0. 9_030440m | 45% (267/583) | 328-378 | KNLVAERKRRKKLN DRLYALRALVPIIT KLDRATILVDAIEY VKQLQKQEK | 477 | 78% (40/51) |
| 264 | Bd/Bradi3g019 10.1 | 45% (125/274) | 287-337 | KNLMAERKRRKKLN DRLYKLRSLVPNIT KMDRASILGDAIDY IVGLQKQVK | 478 | 78% (40/51) |
| 266 | Sl/Solyc08g062 780.1.1 | 44% (263/588) | 327-377 | KNLMAERKRRKKLN ERLYALRALVPKIS KLDRASILGDAIEY VMELEKQVK | 479 | 78% (40/51) |
| 268 | Bd/Bradi3g019 01.1 | 36% (199/538) | 284-334 | KNLMAERNRRKKLN DRLYKLRSLVPNIT KMDRAAILGDAIDY IVGLQKQVK | 480 | 76% (39/51) |
| 270 | Si/Si019518m | 36% (198/541) | 286-336 | KNLVAERKRRKKLN ERLYKLRSLVPNIT KMDRASILGDAIDY IVGLQNQVK | 481 | 76% (39/51) |
| 272 | Zm/GRMZM2 G139372_T02 | 44% (116/262) | 295-345 | KNLEAERKRRKKLN ERLYKLRSLVPNIT KMDRAAILGDAIDY IVGLQNQVK | 482 | 72% (37/51) |
| 274 | Si/Si006199m | 36% (199/552) | 290-340 | KNLVAERKRRQKLN NALYKLRSLVPKIT KMDRASILGDAIDY IVGLQNQVK | 483 | 72% (37/51) |
| 276 | Os/LOC_Os02 g02820.1 | 35% (198/553) | 285-335 | KNLEAERKRRKKLN GHLYKLRSLVPNIT KMDRASILGDAIDY IVGLQKQVK | 484 | 72% (37/51) |
| 278 | Cc/clementine0 .9_032563m | 33% (174/523) | 287-337 | KNLITERNRRNKLK DGLFALRALVPKIS KMDRAAILGDAAEY IKELLQEVD | 485 | 62% (32/51) |

TABLE 9-continued

Conserved 'bHLH domain' of AMS and closely related sequences

| Col. 1 SEQ ID NO: | Col. 2 Species/ Identifier | Col. 3 Percent identity of polypeptide in Col. 1 to AMS | Col. 4 bHLH domain in amino acid coordinates | Col. 5 Conserved bHLH domain | Col. 6 SEQ ID NO: bHLH domain | Col. 7 Percent identity of the bHLH domain in Col. 5 to the bHLH domain of AMS |
|---|---|---|---|---|---|---|
| 280 | Pt/POPTR_000 8s19390.1 | 32% (172/530) | 295-345 | KNLVTERNRRTRIK TGLFALRALVPKIS KMDKAAILGDAIDY VGELLKEVK | 486 | 58% (30/51) |

These functionally-related and/or closely-related AMS clade polypeptides may be identified by a consensus bHLH sequence, SEQ ID NO: 518:
$KNX^3X^4X^5ERX^8RRX^{11}X^{12}X^{13}X^{14}X^{15}X^{16}LX^{18}X^{19}LRX^{22}$
$LVPX^{26}IX^{28}KX^{30}DX^{32}AX^{34}ILX^{37}DAX^{40}X^{41}X^{42}X^{43}X^{44}$
$X^{45}LX^{47}X^{48}X^{49}X^{50}X^{51}$
where $X^3$=I, L, V or M; $X^4$=any amino acid; $X^5$=A or T; $X^8$=any amino acid; $X^{11}$=any amino acid; $X^{12}$=R or K; $X^{13}$=I, L, V or M; $X^{14}$=N or K; $X^{15}$=any amino acid; $X^{16}$=any amino acid; $X^{18}$=F or Y; $X^{19}$=any amino acid; $X^{22}$=A or S; $X^{26}$=any amino acid; $X^{28}$=S or T; $X^{30}$=I, L, V or M; $X^{32}$=K or R; $X^{34}$=A, S or T; $X^{37}$=any amino acid; $X^{40}$=A, I, L, V or M; $X^{41}$=D, N or E; $X^{42}$=F or Y; $X^{43}$=I, L, V or M; $X^{44}$=any amino acid; $X^{45}$=any amino acid; $X^{47}$=any amino acid; $X^{48}$=Q, N or K; $X^{49}$=Q or E; $X^{50}$=any amino acid; and $X^{51}$=D or K.

WOX1 (AT3G18010.1 or G1539) Clade Polypeptides

TABLE 10

Conserved 'Homeodomain' of WOX1 and closely related sequences

| Col. 1 SEQ ID NO: | Col. 2 Species/ Identifier | Col. 3 Percent identity of polypeptide in Col. 1 to WOX1 | Col. 4 Homeo- domain in amino acid coordinates | Col. 5 Conserved homeodomain | Col. 6 SEQ ID NO: homeo- domain | Col. 7 Percent identity of the homeodomain in Col. 5 to the homeodomain of WOX1 |
|---|---|---|---|---|---|---|
| 282 | At/WOX1 (AT3G18010.1) | 100% (350/350) | 73-135 | VSSRWNPTPDQLRVL EELYRQGTRTPSADH IQQITAQLRRYGKIE GKNVFYWFQNHKARE RQK | 487 | 100% (63/63) |
| 284 | Eg/Eucgr.B009 45.1 | 40% (158/394) | 77-139 | VSSRWNPTPEQLRTL EELYRRGTRTPNADQ IQQITAQLRRYGKIE GKNVFYWFQNHKARE RQK | 488 | 92% (58/63) |
| 286 | Gm/Glyma08g 05830.1 | 58% (98/167) | 80-142 | VSSRWNPTPEQLRAL EELYRRGTRTPSAEQ IQQITAQLRRFGKIE GKNVFYWFQNHKARE RQK | 489 | 90% (57/63) |
| 288 | Gm/Glyma05g 33850.1 | 40% (158/387) | 78-140 | VSSRWNPTPEQLRAL EELYRRGTRTPSAEQ IQQITAQLRRFGKIE GKNVFYWFQNHKARE RQK | 490 | 90% (57/63) |
| 290 | Vv/GSVIVT01 008424001 | 4 0% (156/385) | 75-137 | VSSRWNPTPEQLRTL EELYRRGTRTPSAEQ IQHITAQLRRYGKIE GKNVFYWFQNHKARE RQK | 491 | 90% (57/63) |
| 292 | Sl/Solyc03g118 770.2.1 | 37% (159/427) | 74-136 | VSSRWNPTPEQLQTL EELYRRGTRTPSAEQ IQHITAQLRRYGKIE GKNVFYWFQNHKARE RQK | 492 | 88% (56/63) |

TABLE 10-continued

Conserved 'Homeodomain' of WOX1 and closely related sequences

| Col. 1 SEQ ID NO: | Col. 2 Species/ Identifier | Col. 3 Percent identity of polypeptide in Col. 1 to WOX1 | Col. 4 Homeo- domain in amino acid coordinates | Col. 5 Conserved homeodomain | Col. 6 SEQ ID NO: homeo- domain | Col. 7 Percent identity of the homeodomain in Col. 5 to the homeodomain of WOX1 |
|---|---|---|---|---|---|---|
| 294 | Gm/Glyma07g 11370.1 | 58% (93/158) | 79-141 | VSSRWNPTPEQLRAL EELYRRGTRTPSAEQ IQHITAQLRRFGNIE GKNVFYWFQNHKARE RQK | 493 | 87% (55/63) |
| 296 | Pt/POPTR_001 2s04510.1 | 34% (146/419) | 88-150 | MSSRWNPTPEQLRTL EELYRRGTRTPSTDQ IQDITAQLRRYGRIE GKNVFYWFQNHKARE RQK | 494 | 87% (55/63) |
| 298 | Gm/Glyma09g 30830.1 | 54% (84/153) | 16-78 | VSSRWNPSPEQLRAL EELYRRGTRTPSAEQ IQHITAQLRRFGNIE GKNVFYWFQNHKARE RQK | 495 | 85% (54/63) |
| 300 | Pt/POPTR_001 5s04520.1 | 38% (162/424) | 93-155 | MSSRWNPTPEQLRTL EDLYRRGTRTPSTDQ IQDITAQLRRYGRIE GKNVFYWFQNHKARE RQK | 496 | 85% (54/63) |
| 302 | Vv/GSVIVT01 011738001 | 41% (107/259) | 83-145 | GSSRWNPTPEQLQAL EELYRRGTRTPTAEQ IQQIAAQLRLFGKIE GKNVFYWFQNHKARE RQK | 497 | 82% (52/63) |
| 304 | Gm/Glyma20g 02160.1 | 80% (56/70) | 65-127 | QSTRWSPTPVQLLVL EELYRQGTKTPSAEQ IQQIASQLRQFGKIE GKNVFYWFQNHKARE RQK | 498 | 80% (51/63) |
| 306 | At/AT5G59340.1 | 72% (48/66) | 11-73 | SSSRWNPTKDQITLL ENLYKEGIRTPSADQ IQQITGRLRAYGHIE GKNVFYWFQNHKARQ RQK | 499 | 76% (48/63) |
| 308 | Gm/Glyma11g 14940.1 | 69% (48/69) | 14-76 | ASSRWNPTKEQISML ENLYKQGIKTPSAEE IQQITARLRAYGHIE GKNVFYWFQNHKARQ RQK | 500 | 74% (47/63) |
| 310 | Pt/POPTR_001 0s12150.1 | 31% (117/372) | 65-127 | RSSRWNPTAEQLLAL EEKYSCGVRTPTTNQ IQQITSELRRFGKIE GKNVFYWFQNHKARE RQK | 501 | 74% (47/63) |
| 312 | Sl/Solyc06g076 000.1.1 | 69% (46/66) | 16-78 | VGCRWNPTKEQIDLL ESLYKQGIRTPSADQ IQQITGRLRAFGHIE GKNVFYWFQNHKARQ RQK | 502 | 73% (46/63) |
| 314 | Eg/Eucgr.B023 79.1 | 68% (46/67) | 10-72 | ATSRWNPTKEQIGIL ESLYRQGIRTPTADQ IQQITGRLRKAYGHIE GKNVFYWFQNHKARQ RQK | 503 | 73% (46/63) |

TABLE 10-continued

Conserved 'Homeodomain' of WOX1 and closely related sequences

| Col. 1 SEQ ID NO: | Col. 2 Species/ Identifier | Col. 3 Percent identity of polypeptide in Col. 1 to WOX1 | Col. 4 Homeo-domain in amino acid coordinates | Col. 5 Conserved homeodomain | Col. 6 SEQ ID NO: homeo-domain | Col. 7 Percent identity of the homeodomain in Col. 5 to the homeodomain of WOX1 |
|---|---|---|---|---|---|---|
| 316 | Os/LOC_Os01 g62310.1 | 66% (46/69) | 41-103 | ANARWTPTKEQIAVL EGLYRQGLRTPTAEQ IQQITARLREHGHIE GKNVFYWFQNHKARQ RQK | 504 | 71% (45/63) |
| 318 | Si/Si004427m | 64% (44/68) | 40-102 | ANARWNPTKEQLAAL EGLYEHGLRTPSAEQ IKQITARLREHGHIE GKNVFYWFQNHKARQ RQK | 505 | 69% (44/63) |
| 320 | Gm/Glyma13g 41000.1 | 61% (46/75) | 18-80 | SVSRWSPTKEQIDML ENLYKQGIRTPSTEQ IQQITSRLRAYGHIE GKNVFYWFQNHKARQ RQK | 506 | 69% (44/63) |
| 322 | Zm/GRMZM2 G108933_T01 | 63% (43/68) | 38-100 | ANARWNPTKEQVAVL EGLYEHGLRTPSAEQ IQQITGRLREHGAIE GKNVFYWFQNHKARQ RQR | 507 | 68% (43/63) |
| 324 | Gm/Glyma15g 04460.1 | 63% (43/68) | 22-84 | SVSRWSPTKEQIDML ENFYKQGIRTPSTEQ IQQITSRLRAYGYIE GKNVFYWFQNHKARQ RQK | 508 | 68% (43/63) |
| 326 | Pt/POPTR_000 9s03460.1 | 64% (42/65) | 16-78 | GNSRWNPTKEQISML ESFYSQGIRTPSIEM IEQITSRLKAYGHIE GKNVFYWFQNHKARQ RQK | 509 | 66% (42/63) |
| 328 | Pt/POPTR_000 1s24470.1 | 61% (41/67) | 11-73 | VNSRWSPTKEQISML ESFYSQGIRTPS1EM IEQIASRLKAYGHIE GKNVFYWFQNHKARQ RQK | 510 | 65% (41/63) |

These functionally-related and/or closely-related WOX1 clade polypeptides may be identified by a consensus homeodomain sequence, SEQ ID NO: 519:
$X^1X^2X^3RWX^6PX^8X^9X^{10}QX^{12}X^{13}X^{14}LEX^{17}X^{18}YX^{20}X^{21}GX^{23}X^{24}TPX^{27}X^{28}X^{29}X^{30}IX^{32}X^{33}IX^{32}X^{33}X^{35}X^{36}X^{37}L X^{39}X^{40}X^{41}GX^{43}IEGKNVFYWFQNHKARX^{60}RQX^{63}$
where $X^1$=any amino acid; $X^2$=any amino acid; $X^3$=S, A, T or C; $X^6$=any amino acid; $X^8$=S or T; $X^9$=any amino acid; $X^{10}$=any amino acid; $X^{12}$=I, L, V or M; $X^{13}$=any amino acid; $X^{14}$=A, T, I, L, V or M; $X^{17}$=any amino acid; $X^{18}$=any amino acid; $X^{20}$=any amino acid; $X^{21}$=any amino acid; $X^{23}$=T, I, L, V or M; $X^{24}$=K or R; $X^{27}$=any amino acid; $X^{28}$=A or T; $X^{29}$=D, N or E; $X^{30}$=any amino acid; $X^{32}$=Q, E or K; $X^{33}$=any amino acid; $X^{35}$=A or T; $X^{36}$=S, A or G; $X^{37}$=Q, R or E; $X^{39}$=R or K; $X^{40}$=any amino acid; $X^{41}$=any amino acid; $X^{43}$=any amino acid; $X^{60}$=Q or E; and $X^{63}$=K or R.

Alternative consensus sequences comprising the above with conservative substitutions found in the instant Tables are also envisaged and may be expected to provide equivalent function(s).

The presence of one or more of these consensus sequences and/or these amino acid residues is correlated with conferring of improved or increased photosynthetic resource use efficiency to a plant when the expression level of the polypeptide is altered in a plant by being reduced, knocked-out, or overexpressed. An ERF015, AtbHLH031, NF-YC8, GATA4, WUS, ERF054, AMS, or WOX1 clade polypeptide sequence that is "functionally-related and/or closely-related" to the listed full length protein sequences or domains provided in the instant Tables may also have, to any of the listed sequences found in the Sequence Listing or to the entire length of a listed sequence, at least 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95% or 96%, 97%, 98%, 99%, or about 100% amino acid identity to any of SEQ ID NOs: 2, 62, 106, 138, 174, 204, 246, or 282 or SEQ ID NOs: 2n where n=1 to 164, and/or at least 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95% or 96%, 97%, 98%, 99%, or about 100% amino acid identity to a domain of any of SEQ ID NOs: 329-510, and/or at least 90%, 91%, 92%, 93%, 94%, 95%, 96%, 97%, 98%, 99%, or about 100% identity to any of consensus sequences SEQ ID NOs: 511-519. The presence of the listed domains in a listed polypeptide sequence is correlated with the conferring of improved or increased photosynthetic resource use efficiency to a plant when the expression level of the polypeptide is altered in a plant by being reduced, knocked-out, or overexpressed. All of the sequences that adhere to these functional and sequential relationships are herein referred to as ERF015, Atb-HLH031, NF-YC8, GATA4, WUS, ERF054, AMS, or WOX1 clade polyppetides exemplified in the phylogenetic trees presented in the Figures.

Example II. Plant Genotypes and Vector and Cloning Information

A variety of constructs may be used to modulate the activity of regulatory polypeptides (RPs), and to test the activity of orthologs and paralogs in transgenic plant material. This platform provides the material for all subsequent analysis.

An individual plant "genotype" refers to a set of plant lines containing a particular construct or knockout (for example, this might be 35S lines for a given gene sequence (GID, Gene Identifier) being tested, 35S lines for a paralog or ortholog of that gene sequence, lines for an RNAi construct, lines for a GAL4 fusion construct, or lines in which expression of the gene sequence is driven from a particular promoter that enhances expression in particular cell, tissue or condition). For a given genotype arising from a particular transformed construct, multiple independent transgenic lines may be examined for morphological and physiological phenotypes. Each individual "line" (also sometimes known as an "event") refers to the progeny plant or plants deriving from the stable integration of the transgene(s), carried within the T-DNA borders contained within a transformation construct, into a specific location or locations within the genome of the original transformed cell. It is well known in the art that different lines deriving from transformation with a given transgene may exhibit different levels of expression of that transgene due to so called "position effects" of the surrounding chromatin at the locus of integration in the genome, and therefore it is necessary to examine multiple lines containing each construct of interest.

(1) Overexpression/Tissue-Enhanced/Conditional Expression.

Expression of a given regulatory protein from a particular promoter, for example a photosynthetic tissue-enhanced promoter (e.g., a green tissue- or leaf-enhanced promoter), is achieved either by a direct-promoter fusion construct in which that regulatory protein is cloned directly behind the promoter of interest or by a two component system.

The Two-Component Expression System.

For the two-component system, two separate constructs are used: Promoter::LexA-GAL4TA and opLexA::RP. The first of these (Promoter::LexA-GAL4TA) comprises a desired promoter cloned in front of a LexA DNA binding domain fused to a GAL4 activation domain. The construct vector backbone (pMEN48, also known as P5375) also carries a kanamycin resistance marker, along with an opLexA::GFP (green fluorescent protein) reporter. Transgenic lines are obtained containing this first component, and a line is selected that shows reproducible expression of the reporter gene in the desired pattern through a number of generations. A homozygous population is established for that line, and the population is supertransformed with the second construct (opLexA::RP) carrying the regulatory protein of interest cloned behind a LexA operator site. This second construct vector backbone (pMEN53, also known as P5381) also contains a sulfonamide resistance marker.

Conditional Expression.

Various promoters can be used to overexpress disclosed polypeptides in plants to confer improved photosynthetic resource use efficiency. However, in some cases, there may be limitations in the use of various proteins that confer increased photosynthetic resource use efficiency when the proteins are overexpressed. Negative side effects associated with constitutive overexpression such as small size, delayed growth, increased disease sensitivity, and development and alteration in flowering time are not uncommon A number of stress-inducible promoters can be used promote protein expression during the periods of stress, and therefore may be used to induce overexpression of polypeptides that can confer improved stress tolerance when they are needed without the adverse developmental or morphological effects that may be associated with their constitutive overexpression.

Promoters that drive protein expression in response to stress can be used to regulate the expression of the disclosed polypeptides to confer photosynthetic resource use efficiency to plants. The promoter may regulate expression of a disclosed polypeptide to an effective level in a photosynthetic tissue. Effective level in this regard refers to an expression level that confers greater photosynthetic resource use efficiency in the transgenic plant relative to the control plant that, for example, does not comprise a recombinant polynucleotide that encodes the disclosed polypeptide. Optionally, the promoter does not regulate protein expression in a constitutive manner.

Such promoters include, but are not limited to, the sequences located in the promoter regions of At5g52310 (RD29A), At5g52300, AT1G16850, At3g46230, AT1G52690, At2g37870, AT5G43840, At5g66780, At3g17520, and At4g09600.

In addition, promoters with expression specific to or enhanced in particular cells or tissue types may be used to express a given regulatory protein only in these cells or tissues. Examples of such promoter types include but are not limited to promoters expressed in green tissue, guard cell, epidermis, whole root, root hairs, vasculature, apical meristems, and developing leaves.

Table 22 lists a number of photosynthetic tissue-enhanced promoters, specifically, mesophyll tissue-enhanced promoters from rice, that may be used to regulate expression of polynucleotides and polypeptides found in the Sequence Listing and structurally and functionally-related sequences.

Promoters that may be used to drive expression of polynucleotides and polypeptides found in the Sequence Listing and structurally and functionally-related sequences included, but are not limited to, promoter sequences SEQ ID NO: 520, 521 and 522- and the following promoters SEQ ID NOs: 523-546 listed in Table 22, as well as promoters that are at least 80%, 81%, 82%, 83%, 84%, 85%, 86%, 87%, 88%, 89%, 90%, 91%, 92%, 93%, 94%, 95% or 96%, 97%, 98%, 99%, or about 100% identical to SEQ ID NO: 520-546, or comprise a functional fragment of promoters that are at least 80%, 81%, 82%, 83%, 84%, 85%, 86%, 87%, 88%, 89%, 90%, 91%, 92%, 93%, 94%, 95% or 96%, 97%, 98%, 99%, or about 100% identical to SEQ ID NO: 520-546.

TABLE 22

Rice Genes with Photosynthetic Tissue-Enhanced Promoters

| SEQ ID NO: | Rice Gene Identifier of Photosynthetic Tissue-Enhanced Promoter |
|---|---|
| 523 | Os02g09720 |
| 524 | Os05g34510 |
| 525 | Os11g08230 |
| 526 | Os01g64390 |
| 527 | Os06g15760 |
| 528 | Os12g37560 |
| 529 | Os03g17420 |
| 530 | Os04g51000 |
| 531 | Os01g01960 |
| 532 | Os05g04990 |
| 533 | Os02g44970 |
| 534 | Os01g25530 |
| 535 | Os03g30650 |
| 536 | Os01g64910 |
| 537 | Os07g26810 |
| 538 | Os07g26820 |
| 539 | Os09g11220 |
| 540 | Os04g21800 |
| 541 | Os10g23840 |
| 542 | Os08g13850 |
| 543 | Os12g42980 |
| 544 | Os03g29280 |
| 545 | Os03g20650 |
| 546 | Os06g43920 |

Tissue-enhanced promoters that may be used to drive expression of polynucleotides and polypeptides found in the Sequence Listing and structurally and functionally-related sequences have also been described in U.S. patent publication no. 20110179520A1, incorporated herein by reference. Such promoters include, but are not limited to, Arabidopsis sequences located in the promoter regions of AT1G08465, AT1G10155, AT1G14190, AT1G24130, AT1G24735, AT1G29270, AT1G30950, AT1G31310, AT1G37140, AT1G49320, AT1G49475, AT1G52100, AT1G60540, AT1G60630, AT1G64625, AT1G65150, AT1G68480, AT1G68780, AT1G69180, AT1G77145, AT1G80580, AT2G03500, AT2G17950, AT2G19910, AT2G27250, AT2G33880, AT2G39850, AT3G02500, AT3G12750, AT3G15170, AT3G16340, AT3G27920, AT3G30340, AT3G42670, AT3G44970, AT3G49950, AT3G50870, AT3G54990, AT3G59270, AT4G00180, AT4G00480, AT4G12450, AT4G14819, AT4G31610, AT4G31615, AT4G31620, AT4G31805, AT4G31877, AT4G36060, AT4G36470, AT4G36850, AT4G37970, AT5G03840, AT5G12330, AT5G14070, AT5G16410, AT5G20740, AT5G27690, AT5G35770, AT5G39330, AT5G42655, AT5G53210, AT5G56530, AT5G58780, AT5G61070, and AT5G6491.

In addition to the sequences provided in the Sequence Listing or in this Example, a promoter region may include a fragment of the promoter sequences provided in the Sequence Listing or in this Example, or a complement thereof, wherein the promoter sequence, or the fragment thereof, or the complement thereof, regulates expression of a polypeptide in a plant cell, for example, in response to a biotic or abiotic stress, or in a manner that is enhanced or preferred in certain plant tissues.

(2) Knock-Out/knock-Down

In some cases, lines mutated in a given regulatory protein may be analyzed. Where available, T-DNA insertion lines in a given gene are isolated and characterized. In cases where a T-DNA insertion line is unavailable, an RNA interference (RNAi) strategy is sometimes used.

Example III. Transformation Methods

Crop species that overexpress polypeptides of the instant description may produce plants with increased photosynthetic resource use efficiency and/or yield. Thus, polynucleotide sequences listed in the Sequence Listing recombined into, for example, one of the expression vectors of the instant description, or another suitable expression vector, may be transformed into a plant for the purpose of modifying plant traits for the purpose of improving yield, quality, and/or photosynthetic resource use efficiency. The expression vector may contain a constitutive, tissue-enhanced or inducible promoter operably linked to the polynucleotide. The cloning vector may be introduced into a variety of plants by means well known in the art such as, for example, direct DNA transfer or *Agrobacterium tumefaciens*-mediated transformation.

Transformation of Monocots.

Cereal plants including corn, wheat, rice, sorghum, barley, or other monocots may be transformed with the present polynucleotide sequences, including monocot or eudicot-derived sequences such as those presented in the present Tables, cloned into a vector such as pGA643 and containing a kanamycin-resistance marker, and expressed constitutively under, for example, the CaMV35S or COR15 promoters, or with tissue-enhanced or inducible promoters. The expression vectors may be one found in the Sequence Listing, or any other suitable expression vector may be similarly used. For example, pMENO20 may be modified to replace the NptII coding region with the BAR gene of *Streptomyces hygroscopicus* that confers resistance to phosphinothricin. The KpnI and BglII sites of the Bar gene are removed by site-directed mutagenesis with silent codon changes.

The cloning vector may be introduced into a variety of cereal plants by means well known in the art including direct DNA transfer or Agrobacterium tumefaciens-mediated transformation. The latter approach may be accomplished by a variety of means, including, for example, that of U.S. Pat. No. 5,591,616, in which monocotyledon callus is transformed by contacting dedifferentiating tissue with the *Agrobacterium* containing the cloning vector.

The sample tissues are immersed in a suspension of $3 \times 10^{-9}$ cells of *Agrobacterium* containing the cloning vector for 3-10 minutes. The callus material is cultured on solid medium at 25° C. in the dark for several days. The calli grown on this medium are transferred to a Regeneration Medium. Transfers are continued every two to three weeks (two or three times) until shoots develop. Shoots are then transferred to Shoot-Elongation Medium every 2-3 weeks. Healthy looking shoots are transferred to Rooting Medium and after roots have developed, the plants are placed into moist potting soil.

The transformed plants are then analyzed for the presence of the NPTII gene/kanamycin resistance by ELISA, using the ELISA NPTII kit from SPrime-3Prime Inc. (Boulder, Colo.).

It is also routine to use other methods to produce transgenic plants of most cereal crops (Vasil, 1994. *Plant Mol. Biol.* 25: 925-937) such as corn, wheat, rice, sorghum (Cassas et al., 1993. *Proc. Natl. Acad. Sci. USA* 90: 11212-

11216), and barley (Wan and Lemeaux, 1994. *Plant Physiol.* 104: 37-48). DNA transfer methods such as the microprojectile method can be used for corn (Fromm et al., 1990. *Bio/Technol.* 8: 833-839; Gordon-Kamm et al., 1990. *Plant Cell* 2: 603-618; Ishida, 1990. *Nature Biotechnol.* 14:745-750), wheat (Vasil et al., 1992. *Bio/Technol.* 10:667-674; Vasil et al., 1993. *Bio/Technol.* 11:1553-1558; Weeks et al., 1993. *Plant Physiol.* 102:1077-1084), and rice (Christou, 1991. *Bio/Technol.* 9:957-962; Hiei et al., 1994. *Plant J.* 6:271-282; Aldemita and Hodges, 1996. *Planta* 199: 612-617; and Hiei et al., 1997. *Plant Mol. Biol.* 35:205-218). For most cereal plants, embryogenic cells derived from immature scutellum tissues are the preferred cellular targets for transformation (Hiei et al., 1997. supra; Vasil, 1994. supra). For transforming corn embryogenic cells derived from immature scutellar tissue using microprojectile bombardment, the A188XB73 genotype is the preferred genotype (Fromm et al., 1990. *Bio/Technol.* 8: 833-839; Gordon-Kamm et al., 1990. supra). After microprojectile bombardment the tissues are selected on phosphinothricin to identify the transgenic embryogenic cells (Gordon-Kamm et al., 1990. supra). Transgenic plants from transformed host plant cells may be regenerated by standard corn regeneration techniques (Fromm et al., 1990. *Bio/Technol.* 8: 833-839; Gordon-Kamm et al., 1990. supra).

Transformation of Dicots.

It is now routine to produce transgenic plants using most eudicot plants (see U.S. Pat. No. 8,273,954 (Rogers et al.) issued Sep. 25, 2012; Weissbach and Weissbach, 1989. *Methods for Plant Molecular Biology*, Academic Press; Gelvin et al., 1990. *Plant Molecular Biology Manual*, Kluwer Academic Publishers; Herrera-Estrella et al., 1983. *Nature* 303: 209; Bevan, 1984. *Nucleic Acids Res.* 12: 8711-8721; and Klee, 1985. *Bio/Technology* 3: 637-642). Methods for analysis of traits are routine in the art and examples are disclosed above.

Numerous protocols for the transformation of tomato and soy plants have been previously described, and are well known in the art. Gruber et al., in Glick and Thompson, 1993. *Methods in Plant Molecular Biology and Biotechnology*. eds., CRC Press, Inc., Boca Raton, describe several expression vectors and culture methods that may be used for cell or tissue transformation and subsequent regeneration. For soybean transformation, methods are described by Miki et al., 1993. in *Methods in Plant Molecular Biology and Biotechnology*, p. 67-88, Glick and Thompson, eds., CRC Press, Inc., Boca Raton; and U.S. Pat. No. 5,563,055, (Townsend and Thomas), issued Oct. 8, 1996.

There are a substantial number of alternatives to *Agrobacterium*-mediated transformation protocols, other methods for the purpose of transferring exogenous genes into soybeans or tomatoes. One such method is microprojectile-mediated transformation, in which DNA on the surface of microprojectile particles is driven into plant tissues with a biolistic device (see, for example, Sanford et al., 1987. *Part. Sci. Technol.* 5:27-37; Sanford, 1993. *Methods Enzymol.* 217: 483-509; Christou et al., 1992. *Plant. J.* 2: 275-281; Klein et al., 1987. *Nature* 327: 70-73; U.S. Pat. No. 5,015,580 (Christou et al), issued May 14, 1991; and U.S. Pat. No. 5,322,783 (Tomes et al.), issued Jun. 21, 1994).

Alternatively, sonication methods (see, for example, Zhang et al., 1991. *Bio/Technology* 9: 996-997); direct uptake of DNA into protoplasts using $CaCl_2$ precipitation, polyvinyl alcohol or poly-L-ornithine (see, for example, Hain et al., 1985. *Mol. Gen. Genet.* 199: 161-168; Draper et al., 1982. *Plant Cell Physiol.* 23: 451-458); liposome or spheroplast fusion (see, for example, Deshayes et al., 1985. *EMBO J.*, 4: 2731-2737; Christou et al., 1987. *Proc. Natl. Acad. Sci. USA* 84: 3962-3966); and electroporation of protoplasts and whole cells and tissues (see, for example, Donn et al. 1990. in *Abstracts of VIIth International Congress on Plant Cell and Tissue Culture IAPTC*, A2-38: 53; D'Halluin et al., 1992. *Plant Cell* 4: 1495-1505; and Spencer et al., 1994. *Plant Mol. Biol.* 24: 51-61) have been used to introduce foreign DNA and expression vectors into plants.

After a plant or plant cell is transformed (and the transformed host plant cell then regenerated into a plant), the transformed plant may propagated vegetatively or it may be crossed with itself or a plant from the same line, a non-transformed or wild-type plant, or another transformed plant from a different transgenic line of plants. Crossing provides the advantages of producing new and often stable transgenic varieties. Genes and the traits they confer that have been introduced into a tomato or soybean line may be moved into distinct line of plants using traditional backcrossing techniques well known in the art. Transformation of tomato plants may be conducted using the protocols of Koornneef et al, 1986. In *Tomato Biotechnology*: Alan R. Liss, Inc., 169-178, and in U.S. Pat. No. 6,613,962, the latter method described in brief here. Eight day old cotyledon explants are precultured for 24 hours in Petri dishes containing a feeder layer of *Petunia hybrida* suspension cells plated on MS medium with 2% (w/v) sucrose and 0.8% agar supplemented with 10 μM α-naphthalene acetic acid and 4.4 μM 6-benzylaminopurine. The explants are then infected with a diluted overnight culture of *Agrobacterium tumefaciens* containing an expression vector comprising a polynucleotide of the instant description for 5-10 minutes, blotted dry on sterile filter paper and cocultured for 48 hours on the original feeder layer plates. Culture conditions are as described above. Overnight cultures of *Agrobacterium tumefaciens* are diluted in liquid MS medium with 2% (w/v/) sucrose, pH 5.7, to an $OD_{600}$ of 0.8.

Following cocultivation, the cotyledon explants are transferred to Petri dishes with selective medium comprising MS medium with 4.56 μM zeatin, 67.3 μM vancomycin, 418.9 μM cefotaxime and 171.6 μM kanamycin sulfate, and cultured under the culture conditions described above. The explants are subcultured every three weeks onto fresh medium. Emerging shoots are dissected from the underlying callus and transferred to glass jars with selective medium without zeatin to form roots. The formation of roots in a kanamycin sulfate-containing medium is a positive indication of a successful transformation.

Transformation of soybean plants may be conducted using the methods found in, for example, U.S. Pat. No. 5,563,055 (Townsend et al., issued Oct. 8, 1996), described in brief here. In this method soybean seed is surface sterilized by exposure to chlorine gas evolved in a glass bell jar. Seeds are germinated by plating on ⅒ strength agar solidified medium without plant growth regulators and culturing at 28° C. with a 16 hour day length. After three or four days, seed may be prepared for cocultivation. The seedcoat is removed and the elongating radicle removed 3-4 mm below the cotyledons.

*Eucalyptus* is now considered an important crop that is grown for example to provide feedstocks for the pulp and paper and biofuel markets. This species is also amenable to transformation as described in PCT patent publication WO/2005/032241.

*Crambe* has been recognized as a high potential oilseed crop that may be grown for the production of high value oils.

An efficient method for transformation of this species has been described in PCT patent publication WO 2009/067398 A1.

Overnight cultures of *Agrobacterium tumefaciens* harboring the expression vector comprising a polynucleotide of the instant description are grown to log phase, pooled, and concentrated by centrifugation. Inoculations are conducted in batches such that each plate of seed was treated with a newly resuspended pellet of *Agrobacterium*. The pellets are resuspended in 20 ml inoculation medium. The inoculum is poured into a Petri dish containing prepared seed and the cotyledonary nodes are macerated with a surgical blade. After 30 minutes the explants are transferred to plates of the same medium that has been solidified. Explants are embedded with the adaxial side up and level with the surface of the medium and cultured at 22° C. for three days under white fluorescent light. These plants may then be regenerated according to methods well established in the art, such as by moving the explants after three days to a liquid counter-selection medium (see U.S. Pat. No. 5,563,055).

The explants may then be picked, embedded and cultured in solidified selection medium. After one month on selective media transformed tissue becomes visible as green sectors of regenerating tissue against a background of bleached, less healthy tissue. Explants with green sectors are transferred to an elongation medium. Culture is continued on this medium with transfers to fresh plates every two weeks. When shoots are 0.5 cm in length they may be excised at the base and placed in a rooting medium.

Experimental Methods; Transformation of *Arabidopsis*.

Transformation of *Arabidopsis* is performed by an *Agrobacterium*-mediated protocol based on the method of Bechtold and Pelletier, 1998. Unless otherwise specified, all experimental work is performed using the Columbia ecotype.

Plant Preparation.

*Arabidopsis* seeds are gas sterilized and sown on plates with media containing 80% MS with vitamins, 0.3% sucrose and 1% Bacto™ agar. The plates are placed at 4° in the dark for the days then transferred to 24 hour light at 22° for 7 days. After 7 days the seedlings are transplanted to soil, placing individual seedlings in each pot. The primary bolts are cut off a week before transformation to break apical dominance and encourage auxiliary shoots to form. Transformation is typically performed at 4-5 weeks after sowing.

Bacterial Culture Preparation.

*Agrobacterium* stocks are inoculated from single colony plates or from glycerol stocks and grown with the appropriate antibiotics until saturation. On the morning of transformation, the saturated cultures are centrifuged and bacterial pellets are re-suspended in Infiltration Media (0.5× MS, 1× Gamborg's Vitamins, 5% sucrose, 200 µ/L Silwet® L77) until an $A_{600}$ reading of 0.8 is reached.

Transformation and Harvest of Transgenic Seeds.

The *Agrobacterium* solution is poured into dipping containers. All flower buds and rosette leaves of the plants are immersed in this solution for 30 seconds. The plants are laid on their side and wrapped to keep the humidity high. The plants are kept this way overnight at 22° C. and then the pots are turned upright, unwrapped, and moved to the growth racks. In most cases, the transformation process is repeated one week later to increase transformation efficiency.

The plants are maintained on the growth rack under 24-hour light until seeds are ready to be harvested. Seeds are harvested when 80% of the siliques of the transformed plants are ripe (approximately five weeks after the initial transformation). This seed is deemed $T_0$ seed, since it is obtained from the $T_0$ generation, and is later plated on selection plates (either kanamycin or sulfonamide). Resistant plants that are identified on such selection plates comprise the T1 generation, from which transgenic seed comprising an expression vector of interest may be derived.

Example IV. Primary Screening Materials and Methods

Plant Growth Conditions.

Seeds from *Arabidopsis* lines are chlorine gas sterilized using a standard protocol and spread onto plates containing a sucrose-based media augmented with vitamins (80% MS+Vit, 1% sucrose, 0.65% PhytoBlend™ Agar; Caisson Laboratories, Inc., North Logan, Utah) and appropriate kanamycin or sulfonamide concentrations where selection is required. Seeds are stratified in the dark on plates, at 4° C. for 3 days then moved to a walk-in growth chamber (Conviron MTW120, Conviron Controlled Environments Ltd, Winnipeg, Manitoba, Canada) running at a 10 hour photoperiod at a photosynthetic photon flux of approximately 200 µmol $m^{-2}$ $s^{-1}$ at plant height and a photoperiod/night temperature regime of 22° C./19° C. After seven days of light exposure seedlings are transplanted into 164 ml volume pots containing autoclaved ProMix® soil. All pots are returned to the same growth-chamber where they are stood in water and covered with a lid for the first seven days. This protocol keeps the soil moist during this period. Seven days after transplanting lids are removed and a watering and nutrition regime begun. All plants receive water three times a week, and a weekly a fertilizer treatment (80% Peter's NPK fertilizer).

Primary Screening.

Between 35 and 38 days after being transferred to lighted conditions on plates, and after between 28 and 31 days growth in soil, a suite of leaf-physiological parameters are measured using an infrared gas analyzer (LI-6400XT, LI-COR® Biosciences, Lincoln, Neb., USA) integrated with a fluorimeter that measures fluorescence from Chlorophyll A (LI-6400-40, LI-COR Biosciences). This technique involves clamping a leaf between two gaskets, effectively sealing it inside a chamber, then measuring the exchange of carbon dioxide and water vapor between the leaf and the air flowing through the chamber. This gas exchange is monitored simultaneously with the fluorescence levels from the chlorophyll a molecules in the leaf. The growth conditions used, and plant age and leaf selection criteria for measurement are designed to maximize the chance that the leaves sampled fill the 2 cm² leaf chamber of the gas-exchange system and that plants show no visible signs of having transitioned to reproductive growth.

Screening High-Light Leaf Physiology at Two Air Temperatures.

Leaf physiology is screened after plants have been acclimated to high light (700 µmol photons $m^{-2}$ $s^{-1}$) under LED light banks emitting visible light (400-700 nm, Photon Systems Instruments, Brno, Czech Republic), for 40 minutes. Other than the change in light level, the atmospheric environment is the same as that in which the plants have been grown, and the LI-6400 leaf chamber is set to reflect this, being set to deliver a photosynthetic photon flux of 700 µmol photons $m^{-2}$ $s^{-1}$ and operate at an air temperature of 22° C. Forty minutes acclimation to a photosynthetic photon flux of 700 µmol photons $m^{-2}$ $s^{-1}$ has repeatedly been shown to be sufficient to achieve a steady-state rate of light-saturated photosynthesis and stomatal conductance in control plants. Gas exchange and fluorescence data are logged simultaneously two minutes after the leaf has been closed in the chamber. Two minutes is found to be long enough for the leaf chamber $CO_2$ and $H_2O$ concentrations to stabilize after closing a new leaf inside, and thereby minimizing leaf physiological adjustment to small differences between the growth environment and the LI-6400 chamber. Screening at the growth air temperature of 22° C. is begun one hour into the photoperiod and is typically completed in two hours. After being screened at 22° C., plants are returned to growth-light levels prior to being screened again at 35° C. later in the photoperiod. The higher-temperature screening begins six hours into the photoperiod and measurements are made after the rosettes have been acclimated to the same high light dose as described above, but this time in a controlled environment with an air temperature set to 35° C. Measurements are again made in a leaf chamber set to match the warmer air temperature and logged using the protocol described above for the 22° C. measurements. Data generated at both 22° C. and 35° C. are used to calculate: rates of $CO_2$ assimilation by photosynthesis (A, µmol $CO_2$ m$^{-2}$ s$^{-1}$); rates of $H_2O$ loss through transpiration (Tr, mmol $H_2O$ m$^{-2}$ s$^{-1}$); the conductance to $CO_2$ and $H_2O$ movement between the leaf and air through the stomatal pore ($g_s$, mol. $H_2O$ m$^{-2}$ c$^{-1}$); the sub-stomatal $CO_2$ concentration ($C_i$, µmol $CO_2$ mol$^{-1}$); transpiration efficiency, the instantaneous ratio of photosynthesis to transpiration, (TE=A/Tr (µmol $CO_2$ mmol $H_2O$ m$^{-2}$ s$^{-1}$)); the rate of electron flow through photosystem two (ETR µmol e-m$^{-2}$ s$^{-1}$). Derivation of the parameters described above followed established published protocols (Long & Bernacchi, 2003. *J. Exp. Botany;* 54:2393-24)

Leaves from up to 10 replicate plants are screened for a given line of interest. Data generated from these lines are compared with that from an empty vector control line planted at the same time, grown within the same flats, and screened at the same time.

For control lines, data are collected not only at an atmospheric $CO_2$ concentration of 400 µmol $CO_2$ mol$^{-1}$, but also after stepwise changes in $CO_2$ concentration to 350, 300, 450 and 500 µmol $CO_2$ mol$^{-1}$. These measurements underlay screening for more complex physiological traits of: (1) photosynthetic capacity; (2) Non-photochemical quenching; and (3) non-photosynthetic metabolism.

Screening Photosynthetic Capacity.

Under most conditions, the rate of light-saturated photosynthesis in a C3 leaf is a product of the biochemical capacity of the Calvin cycle and the transfer conductance of $CO_2$ concentration to the sites of carboxylation (Farquhar et al., 1980. *Planta:*149, 78-90). Plotting the rate of photosynthesis against an estimate of the sub-stomatal $CO_2$ concentration ($C_i$) provides a means to identify changes in photosynthetic capacity of the Calvin cycle independent of changes in stomatal conductance, a key component of the total transfer conductance to $CO_2$ of the leaf. Consequently, for lines being screened, rates of photosynthesis are plotted against a regression plot of A vs. $C_i$ generated for the control lines over a range of atmospheric $CO_2$ concentration, as described above. This technique enables visual confirmation of changes in photosynthetic capacity in lines of interest.

Screening Non-Photochemical Quenching.

During acclimation to high light, the efficiency with which photosystem PSII operates will reach a steady state regulated largely by the feedback between non-photochemical quenching (NPQ) in the antenna and the metabolic demand for energy produced in the chloroplast (Genty et al., 1989. *Biochim. Biophys. Acta* 990:87-92; Baker et al., 2007. *Plant Cell Environ.* 30:1107-1125). This understanding is used in this screen to identify lines in which the limitation that non-photochemical quenching exerts on the efficiency with which photosystem II operates is decreased or increased. A decrease in non-photochemical quenching may be the consequence of a decrease in the capacity for NPQ. This would result in lower levels of non-photochemical quenching and a higher efficiency of photosynthesis over a range of light levels, but importantly, higher rates of photosynthesis at low light where light-use efficiency is important. However, changes in rate at which NPQ responds to light could also underlie any increases or decreases in NPQ. Of these, an increase in the rate at which NPQ relaxes has the potential to increase rates of photosynthesis as leaves in crop canopies transition from high to low light, and is therefore relevant to increasing crop-canopy photosynthesis (Zhu et al., 2010. *Plant Biol.* 61:235-261). In keeping with the A/Ci analysis described above, a regression of the operating efficiency of PSII against non-photochemical quenching is generated for the control line from data collected over a range of atmospheric $CO_2$ concentration. This technique enables visual confirmation of changes in the regulation of PSII operation that are driven by changes in non-photochemical quenching in lines of interest.

Screening for Non-Photosynthetic Metabolism.

Measurement of the ratio of the rate of electron flow through PSII (ETR) to the rate of photosynthesis (A) is used to screen for changes in non-photosynthetic metabolism. This screen is based upon the understanding that the transport of four µmol of electrons from PSII to photosystem one PSI will supply the NADPH and ATP required to fix one µmol of $CO_2$ in the Calvin cycle. For a C3 leaf operating in an atmosphere with 21% oxygen, the ratio of electron flow to photosynthesis should be higher than four, reflecting photorespiratory and other metabolism. However, because the rate of photorespiration in a C3 leaf is dependent upon the concentration of $CO_2$ at the active site of Rubisco, a regression of the ratio of electron flow to photosynthesis, generated over the range of $CO_2$ concentrations described above, provides the reference regression against which lines being screened can be compared to controls. Changes in the ratio of ETR to A, when observed at the same $C_i$ as the control line, could indicate changes in the specificity of the Rubisco active site for $O_2$ relative to $CO_2$ and or other metabolic sinks which would be expected to have important implications for crop productivity and/or stress tolerance.

Surrogate Screening for Growth-Light Physiology.

Rosette biomass: the dry weight of whole *Arabidopsis* rosettes (i.e., above-ground biomass) is measured after being dried down at 80° C. for 24 hours, a time found to be sufficient to reach constant weight. Samples are taken after 35-38 days growth, and used as an assay of above-ground productivity at growth light. Typically, five replicate rosettes are sampled per *Arabidopsis* line being screened.

Rosette chemical and isotopic C and N analysis: after weighing, the five rosettes sampled for each line screened are pooled together and ground to a fine powder. The pooled sample generated is sub-sampled and approximately 4 µg samples are prepared for analysis.

Chlorophyll content index (CCI): measurements of light transmission through the leaf are made for plants being screened using a chlorophyll content meter (CCM-200, Apogee Instruments, Logan, Utah, USA). The first is made within the first hour of the photoperiod prior to any acclimation to high light on leaves of plants samples for rosette analysis. The second is made later in the photoperiod on leaves of plants that had undergone the high-temperature screening.

Light absorption: measurements of CCI are used as a surrogate for leaf light absorption, based upon a known relationship between the two. The estimates of light absorption by the leaf, required to construct this relationship, were made by placing the leaf on top of a quantum sensor (LI-190, LI-COR Biosciences) with both the leaf and quantum sensor then pressed firmly up to the foam gasket underneath the LI-6400 light source. This procedure provides an estimate of the transmission of a known light flux through the leaf and is used to estimate the fraction of light absorbed by the leaf.

Example V. Experimental Results

This Example provides experimental observations for transgenic plants overexpressing ERF015, AtbHLH031, NF-YC8, GATA4, or WOX1-related polypeptides assayed for increased photosynthetic resource use-efficiency achieved by improved stress tolerance and, AMS, WUS or ERF054-related polypeptides assayed for the increased photosynthetic resource-use efficiency achieved by improved water-use efficiency.

The ability of a crop canopy to photosynthesize, and the rate at which it can do this relative to the availability of resources, is an important determinant of crop yield. Productive acres typically experience mild, frequent stress which will typically constrain rates of photosynthesis during the stress, but after which rates of photosynthesis quickly recover to pre-stress levels. This mild level of stress is in contrast to damage and down regulation of photosynthesis in responses to severe stress, that will compromise rates of photosynthesis long after the stress has been relieved. Consequently the ability to protect against long term down regulation of, or damaged to, the photosynthetic apparatus is considered a pathway to improving crop yield on more marginal lands where crop yield can be impacted by severe weather events.

Results Obtained with ERF015 (SEQ ID NO: 2) Overexpression Lines.

Table 23 describes a decrease in leaf chlorophyll content in five out of five ERF015 overexpression lines for measurements made after acclimation to high light at growth air temperature of 22° C. and four out five lines for measurements made after acclimation to high light an air temperature of 35° C. When averaged for the five lines studied, leaf chlorophyll content was decreased by 12% for measurements made at an air temperature of 22° C. and 11% for measurements made at an air temperature of 35° C.

Decreasing leaf chlorophyll content is expected to be yield relevant on marginal farming acres where severe stress is common Decreased light absorption can decrease photosynthesis under benign environmental conditions. However, as photosynthesis decreases in response to severe stress any reduction in photosynthesis in plants with less chlorophyll will become progressively less important, while the potential for photodamage when photosynthesis is constrained, will be reduced in plants with less chlorophyll. Consequently recovery of photosynthetic competence between episodes of severe stress would be expected to be faster in plants with less chlorophyll, and when integrated over the life of the crop canopy photosynthesis and photosynthetic resource-use efficiency would be expected to increase in crops overexpressing ERF015.

Table 23 also details decreased discrimination against $^{13}C$ relative to $^{12}C$ during photosynthesis, integrated over the life of the rosette, in lines overexpressing ERF015 relative to control lines. The result of decreased discrimination against $^{13}C$ is that the $\delta^{13}C$ signature of the rosette increased by up to 1.4 per mill (‰), and by an average of 0.7 ‰ for five ERF015 overexpression lines assayed. These data in Table 23 are expressed using standard notation described in Farquhar et. al. 1989, supra ($\delta^{13}C$ is a measure of the ratio of isotopes $^{13}C:^{12}C$, relative to the same ratio in a reference and reported herein in parts per thousand (per mil or ‰)) and are of a direction that is routinely interpreted as evidence of an increase in photosynthetic water use efficiency in the published literature, based upon the theory described in Farquhar et. al. 1989, supra.

All experimental observations of greater photosynthetic resource use efficiency were made by comparison to control plants (e.g., plants that did not comprise a recombinant construct encoding a ERF015-related polypeptide or overexpress a ERF015 clade or phylogenetically-related regulatory protein). Where a numerical value was determined, the percentage increases (+%) or decreases (−%) relative to control plants are shown in parentheses.

TABLE 23

Components of increased photosynthetic resource-use efficiency in ERF015 overexpression lines. Effects and relative effect size are displayed for leaf chlorophyll content, and rosette $\delta^{13}C$ composition.

| Polypeptide Sequence/ Line | Driver | Target | Temp (° C.) | Leaf Chl | Rosette $\delta^{13}C$ (per mil) |
|---|---|---|---|---|---|
| ERF015/ Line 1 | prRBCS4::LexA:GAL4_opLexA:: GFP, Col_Wt | opLexA:: G39 | 22 | Decreased (18%) | Increased (0.5‰) |
| ERF015/ Line 2 | prRBCS4::LexA:GAL4_opLexA:: GFP, Col_Wt | opLexA:: G39 | 22 | Decreased (12%) | Increased (0.7‰) |
| ERF015/ Line 3 | prRBCS4::LexA:GAL4_opLexA:: GFP, Col_Wt | opLexA:: G39 | 22 | Decreased (22%) | Increased (0.93‰) |
| ERF015/ Line 4 | prRBCS4::LexA:GAL4_opLexA:: GFP, Col_Wt | opLexA:: G39 | 22 | Decreased (26%) | Increased (0.27‰) |
| ERF015/ Line 5 | prRBCS4::LexA:GAL4_opLexA:: GFP, Col_Wt | opLexA:: G39 | 22 | Decreased (15%) | Increased (1.41‰) |
| ERF015/ Line 1 | prRBCS4::LexA:GAL4_opLexA:: GFP, Col_Wt | opLexA:: G39 | 35 | Decreased (12%) | — |
| ERF015/ Line 2 | prRBCS4::LexA:GAL4_opLexA:: GFP, Col_Wt | opLexA:: G39 | 35 | Decreased (7%) | — |
| ERF015/ Line 3 | prRBCS4::LexA:GAL4_opLexA:: GFP, Col_Wt | opLexA:: G39 | 35 | Decreased (12%) | — |
| ERF015/ Line 4 | prRBCS4::LexA:GAL4_opLexA:: GFP, Col_Wt | opLexA:: G39 | 35 | Decreased (10%) | — |
| ERF015/ Line 5 | prRBCS4::LexA:GAL4_opLexA:: GFP, Col_Wt | opLexA:: G39 | 35 | Increased (5%) | — |

The results presented in Table 23 were determined after screening five independent transgenic events. Lines 1, 2 and 3 were screened twice and the effect size reported above is the mean of the two screening runs. Line 4 and 5 were screened once.

Results Obtained with AtbHLH031 (SEQ ID NO: 62) Overexpression Lines.

FIG. 4 shows higher non-photochemical quenching in five out of six AtbHLH031 overexpression lines, as plants acclimated to a sudden increase in light incident on the leaves. The increase in non-photochemical quenching in the AtbHLH031 overexpression lines was observed during acclimation to 700 μmol PAR $m^{-2}$ $s^{-1}$ and 2000 μmol PAR $m^{-2}$ $s^{-1}$. Non-photochemical quenching is a term that covers a range of processes that collectively dissipate absorbed light energy as heat from the light harvesting antenna of photosystem two (PS2), and reduce the efficiency with which absorbed light is transduced to the PS2 reaction center. These non-photochemcial quenching processes regulate the supply of light energy to photosystem two during stress free conditions, but progressively play a photoprotective role as photosynthesis becomes limited by stress, protecting the photosynthetic apparatus from photodamage.

Increasing non-photochemical quenching is expected to be yield relevant on marginal farming acres where severe stress is common by reducing photodamage to photosynthetic apparatus. By reducing photodamage, recovery of photosynthetic competence between episodes of severe stress would be expected to be faster in plants with higher non-photochemical quenching. When integrated over the life of the crop canopy, photosynthesis and photosynthetic resource-use efficiency would be expected to increase in crops overexpressing AtbHLH031.

All experimental observations of greater photosynthetic resource use efficiency were made by comparison to control plants (e.g., plants that did not comprise a recombinant construct encoding a AtbHLH031-related polypeptide or overexpress a AtbHLH031 clade or phylogenetically-related regulatory protein).

Results Obtained with NF-YC8 (SEQ ID NO: 106) Overexpression Lines.

FIGS. 6 and 7 show higher non-photochemical quenching in seven independent NF-YC8 overexpression lines. FIG. 6 shows a decrease in the maximum efficiency of PS2 operation in four NF-YC8 overexpression lines after 45 minutes acclimation to a light intensity of 700 μmol PAR $m^{-2}$ $s^{-2}$, when normalized to the same operating efficiency of PS2. This effect was repeated for three lines screened twice. When normalized to the same operating efficiency of PS2, a decrease in the maximum efficiency of PS2 provides evidence of increased non-photochemical quenching in the NF-YC8 overexpression lines. FIG. 7 shows higher non-photochemical quenching in three independent NF-YC8 overexpression lines as plants acclimated to a sudden increase in light incident on the leaves. The increase in non-photochemical quenching in the NF-YC8 overexpression lines was observed during acclimation to 700 mol PAR $m^{-2}$ $s^{-1}$ and 2000 μmol PAR $m^{-2}$ $s^{-1}$. Non-photochemical quenching is a term that covers a range of processes that collectively dissipate absorbed light energy as heat from the light harvesting antenna of photosystem two (PS2), and reduce the efficiency with which absorbed light is transduced to the PS2 reaction center. These non-photochemical quenching processes regulate the supply of light energy to photosystem two during stress free conditions, but progressively play a photoprotective role as photosynthesis becomes limited by stress, protecting the photosynthetic apparatus from photodamage.

Increasing non-photochemical quenching is expected to be yield relevant on marginal farming acres where severe stress is common by reducing photodamage to photosynthetic apparatus. By reducing photodamage, recovery of photosynthetic competence between episodes of severe stress would be expected to be faster in plants with higher non-photochemical quenching. When integrated over the life of the crop canopy, photosynthesis and photosynthetic resource-use efficiency would be expected to increase in crops overexpressing NF-YC8.

All experimental observations of greater photosynthetic resource use efficiency were made by comparison to control plants (e.g., plants that did not comprise a recombinant construct encoding a NF-YC8-related polypeptide or overexpress a NF-YC8 clade or phylogenetically-related regulatory protein).

Results Obtained with GATA4 (SEQ ID NO: 138) Overexpression Lines.

Table 24 describes a decrease in leaf chlorophyll content in four out of five GATA4 overexpression lines for measurements made after acclimation to high light at an air temperature of 22° C. and 35° C. When averaged for the four lines studied, leaf chlorophyll content was decreased by 16% for measurements made at an air temperature of 22° C. and 11% for measurements made at an air temperature of 35° C.

Decreasing leaf chlorophyll content is expected to be yield relevant on marginal farming acres where severe stress is common Decreased light absorption and can decrease photosynthesis under benign environmental conditions. However, as photosynthesis decreases in response to severe stress any reduction in photosynthesis in plants with less chlorophyll will become progressively less important, while the potential for photodamage when photosynthesis is constrained, will be reduced in plants with less chlorophyll. Consequently recovery of photosynthetic competence between episodes of severe stress would be expected to be faster in plants with less chlorophyll and when integrated over the life of the crop canopy photosynthesis and photosynthetic resource-use efficiency would be expected to increase in crops overexpressing GATA4.

All experimental observations of greater photosynthetic resource use efficiency were made by comparison to control plants (e.g., plants that did not comprise a recombinant construct encoding a GATA4-related polypeptide or overexpress a GATA4 clade or phylogenetically-related regulatory protein). Where a numerical value was determined, the percentage increases (+%) or decreases (−%) relative to control plants are shown in parentheses.

TABLE 24

Components of increased photosynthetic resource-use efficiency through abiotic stress tolerance in GATA4 overexpression lines. Effects and relative effect size are displayed for leaf chlorophyll content

| Polypeptide Sequence/Line | Driver | Target | Temp (° C.) | Leaf Chl |
|---|---|---|---|---|
| GATA4/Line 1 | prRBCS4::LexA:GAL4_opLexA::GFP, Col_Wt | opLexA::G342 | 22 | Decreased (15%) |
| GATA4/Line 2 | prRBCS4::LexA:GAL4_opLexA::GFP, Col_Wt | opLexA::G342 | 22 | Decreased (8%) |
| GATA4/Line 3 | prRBCS4::LexA:GAL4_opLexA::GFP, Col_Wt | opLexA::G342 | 22 | Decreased (17%) |
| GATA4/Line 4 | prRBCS4::LexA:GAL4_opLexA::GFP, Col_Wt | opLexA::G342 | 22 | Decreased (15%) |
| GATA4/Line 1 | prRBCS4::LexA:GAL4_opLexA::GFP, Col_Wt | opLexA::G342 | 35 | Decreased (12%) |
| GATA4/Line 2 | prRBCS4::LexA:GAL4_opLexA::GFP, Col_Wt | opLexA::G342 | 35 | Decreased (12%) |
| GATA4/Line 3 | prRBCS4::LexA:GAL4_opLexA::GFP, Col_Wt | opLexA::G342 | 35 | Decreased (10%) |
| GATA4/Line 4 | prRBCS4::LexA:GAL4_opLexA::GFP, Col_Wt | opLexA::G39 | 35 | Decreased (9%) |

The results presented in Table 24 were determined after screening five independent transgenic events. Lines 1 and 2 were screened twice and the effect size reported above is the mean of the two screening runs. Line 3 and 4 were screened once.

Results Obtained with WOX1 (SEQ ID NO: 282) Overexpression Lines.

Table 25 describes a decrease stomatal conductance and transpiration in four out of six WOX1 overexpression lines. When averaged for the six lines studied, stomatal conductance and transpiration were 18% and 11% lower respectively Decreasing stomatal conductance and transpiration is expected to be yield relevant on marginal farming acres where severe stress is common. While decreased stomatal conductance can decrease photosynthesis under benign environmental conditions, decreased transpiration could conserve soil water content. On cropland prone to regular drought, soil water conservation would be expected to delay the onset of stomatal closure in response to drought and reduce the severity of the drought. Ultimately, when integrated over the lifecycle of the crop, crop canopy photosynthesis and photosynthetic resource-use efficiency would be expected to increase in crops overexpressing WOX1 on marginal lands.

All experimental observations of greater photosynthetic resource use efficiency were made by comparison to control plants (e.g., plants that did not comprise a recombinant construct encoding a WOX1-related polypeptide or overexpress a WOX1 clade or phylogenetically-related regulatory protein). Where a numerical value was determined, the percentage increases (+%) or decreases (−%) relative to control plants are shown in parentheses.

TABLE 25

Evidence of increased photosynthetic resource use efficiency through abiotic stress tolerance in WOX1 overexpression lines. The direction of the effect and relative size of the effect (%) of WOX1 overexpression relative to a control are shown for, stomatal conductance and transpiration

| Polypeptide Sequence/Line | Driver | Target | Stomatal Conductance | Transpiration |
|---|---|---|---|---|
| WOX1/Line 1 | 35S::m35S::oEnh:LexA:GAL4_opLexA::GFP, Col_W | opLexA::G1539 | Decreased (23%) | Decreased (17%) |
| WOX1/Line 2 | 35S::m35S::oEnh:LexA:GAL4_opLexA::GFP, Col_W | opLexA::G1539 | Decreased (44%) | Decreased (37%) |
| WOX1/Line 3 | 35S::m35S::oEnh:LexA:GAL4_opLexA::GFP, Col_W | opLexA::G1539 | No effect (<1%) | No effect (<1%) |
| WOX1/Line 4 | 35S::m35S::oEnh:LexA:GAL4_opLexA::GFP, Col_W | opLexA::G1539 | Decreased (26%) | Decreased (14%) |
| WOX1/Line 5 | 35S::m35S::oEnh:LexA:GAL4_opLexA::GFP, Col_W | opLexA::G1539 | No effect (<1%) | Increased (6%) |
| WOX1/Line 6 | 35S::m35S::oEnh:LexA:GAL4_opLexA::GFP, Col_W | opLexA::G1539 | Decreased (16%) | Decreased (11%) |

The results presented in Table 25 were determined after screening six independent transgenic events. Lines 1 and 2 were screened twice and the effect size reported above is the mean of the two screening runs. Line 3, 4, 5 and 6 were screened once.

Results Obtained with AMS (SEQ INO: 246) Overexpression Lines.

The ability of a crop canopy to photosynthesize, and the rate at which it can do this relative to the availability of resources, is an important determinant of crop yield. Consequently, increasing the rate of photosynthesis relative to resources that can limit productivity and yield is considered a pathway to improving crop yield across broad acres. Water availability is a key limitation to crop yield, and Table 26 provides data that supports an increase in the water-use efficiency of photosynthesis in AMSoverexpression lines. When assayed at the leaf level water-use efficiency is typically referred to as transpiration efficiency, a term that is expressed as the ratio of μmol of $CO_2$ fixed by photosynthesis to mmol of $H_2O$ transpired from the leaf. Table 26 details increased transpiration efficiency in five out of five AMS overexpression lines studied, relative to control lines. When averaged across all five lines, transpiration efficiency was 13% higher in the AMS overexpression lines than the control line. For the lines studied in Table 26 this 13% increase in transpiration efficiency was the consequence of a 10% decrease in stomatal conductance which resulted in an 8% decrease in transpiration while having no effect on photosynthesis, which increased by 1%.

All experimental observations of greater photosynthetic resource use efficiency were made by comparison to control plants (e.g., plants that did not comprise a recombinant construct encoding a AMS-related polypeptide or overexpress a AMS clade or phylogenetically-related regulatory protein). Where a numerical value was determined, the percentage increases (+%) or decreases (-%) relative to control plants are shown in parentheses.

The results presented in Table 26 were determined after screening five independent transgenic events. Lines 1, 2 and 3 were screened twice and the effect size reported above is the mean of the two screening runs. Line 4 and 5 were screened once.

Results Obtained with WUS (SEQ ID NO: 174) Overexpression Lines.

Table 27 details increased transpiration efficiency in three out of four WUS overexpression lines studied, relative to a control line. When averaged across all four lines, transpiration efficiency was 20% higher in the WUS overexpression lines than the control line for measurements made at 22° C., and 8% higher for measurements made at 35° C. For the lines studied in Table 27, these increases in transpiration efficiency were the consequence of a 31% and 23% decrease in stomatal conductance and 25% and 18% decrease in transpiration, at 22° C. and 35° C. respectively. This decrease in transpiration was greater than the 14% decrease in photosynthesis seen at both 22° C. and 35° C.

All experimental observations of greater photosynthetic resource use efficiency were made by comparison to control plants (e.g., plants that did not comprise a recombinant construct encoding a WUS-related polypeptide or overexpress a WUS clade or phylogenetically-related regulatory protein). Where a numerical value was determined, the percentage increases (+%) or decreases (-%) relative to control plants are shown in parentheses.

TABLE 26

Evidence of increased photosynthetic resource-use efficiency in AMS overexpression lines. The direction of the effect and the relative size of the effect (%) of AMS overexpression is shown for transpiration efficiency, photosynthesis and transpiration.

| Polypeptide Sequence/ Line | Driver | Target | Transpiration Efficiency | Photosynthesis | Transpiration |
|---|---|---|---|---|---|
| AMS/ Line 1 | 35S::m35S::oEnh:LexA: GAL4_opLexA:: GFP, Col_W | opLexA:: G1135 | Increased (6%) | Increased (2%) | Decreased (2%) |
| AMS/ Line 2 | 35S::m35S::oEnh:LexA: GAL4_opLexA:: GFP, Col_W | opLexA:: G1135 | Increased (10%) | Increased (1%) | Decreased (8%) |
| AMS/ Line 3 | 35S::m35S::oEnh:LexA: GAL4_opLexA:: GFP, Col_W | opLexA:: G1135 | Increased (13%) | Increased (2%) | Decreased (10%) |
| AMS/ Line 4 | 35S::m35S::oEnh:LexA: GAL4_opLexA:: GFP, Col_W | opLexA:: G1135 | Increased (14%) | Decreased (1%) | Decreased (9%) |
| AMS/ Line 5 | 35S::m35S::oEnh:LexA: GAL4_opLexA:: GFP, Col_W | opLexA:: G1135 | Increased (23%) | Increased (3%) | Decreased (10%) |

TABLE 27

Evidence of increased photosynthetic resource-use efficiency in WUS overexpression lines.

| Polypeptide Sequence/Line | Driver | Target | Temp (° C.) | T.E. | S.C. | Tr | Photo |
|---|---|---|---|---|---|---|---|
| WUS/Line 1 | 35S::m35S::oEnh:LexA:GAL4_opLexA::GFP, Col_W | opLexA::G1540 | 22 | +26% | −34% | −26% | −8% |
| WUS/Line 2 | 35S::m35S::oEnh:LexA:GAL4_opLexA::GFP, Col_W | opLexA::G1540 | 22 | +28% | −41% | −37% | −21% |
| WUS/Line 3 | 35S::m35S::oEnh:LexA:GAL4_opLexA::GFP, Col_W | opLexA::G1540 | 22 | +34% | −50% | −42% | −24% |
| WUS/Line 4 | 35S::m35S::oEnh:LexA:GAL4_opLexA::GFP, Col_W | opLexA::G1540 | 22 | −9% | no effect <1% | +5% | −4% |
| WUS/Line 1 | 35S::m35S::oEnh:LexA:GAL4_opLexA::GFP, Col_W | opLexA::G1540 | 35 | +10% | −29% | −20% | −13% |
| WUS/Line 2 | 35S::m35S::oEnh:LexA:GAL4_opLexA::GFP, Col_W | opLexA::G1540 | 35 | +12% | −36% | −28% | −20% |
| WUS/Line 3 | 35S::m35S::oEnh:LexA:GAL4_opLexA::GFP, Col_W | opLexA::G1540 | 35 | +14% | −39% | −33% | −25% |
| WUS/Line 4 | 35S::m35S::oEnh:LexA:GAL4_opLexA::GFP, Col_W | opLexA::G1540 | 35 | −3% | +11% | +8% | +4% |

The direction of the effect, increased (+) or decreased (−) and relative size of the effect (%) of WUS overexpression relative to a control are shown for, transpiration efficiency (T.E.), stomatal conductance (S.C.), transpiration (Tr) and photosynthesis (Photo).

The results presented in Table 27 were determined after screening four independent transgenic events. Lines 1 and 2 were screened twice and the effect size reported above is the mean of the two screening runs. Line 3 and 4 were screened once.

Results Obtained with ERF054 (SEQ ID NO: 204) Overexpression Lines.

Table 28 details decreased discrimination against $^{13}C$ relative to $^{12}C$ during photosynthesis, integrated over the life of the rosette, in lines overexpressing ERF054 relative to control lines. The result of decreased discrimination against $^{13}C$ is that the $\delta^{13}C$ signature of the rosette increased by up to 2 per mill (‰), and by an average of 1.1 ‰ for 5 ERF054 overexpression lines assayed. These data in Table 28 are expressed using standard notation described in Farquhar et. al. 1989, supra ($\delta^{13}C$ is a measure of the ratio of isotopes $^{13}C$:$^{12}C$, relative to the same ratio in a reference and reported herein in parts per thousand (per mil or ‰)) and are of a direction that is routinely interpreted as evidence of an increase in photosynthetic water use efficiency in the published literature, based upon the theory described in Farquhar et. al. 1989, supra.

All experimental observations of greater photosynthetic resource use efficiency were made by comparison to control plants (e.g., plants that did not comprise a recombinant construct encoding a ERF054-related polypeptide or overexpress a ERF054 clade or phylogenetically-related regulatory protein). Where a numerical value was determined, the percentage increases (+%) or decreases (−%) relative to control plants are shown in parentheses.

TABLE 28

Evidence of increased photosynthetic resource-use efficiency in ERF054 overexpression lines. Effects on the $^{13}C$ isotopic signature of whole rosettes are described using the standard $\delta^{13}C$ protocol, where the ratio of $^{13}C$ to $^{12}C$ is expressed relative to the same ratio in a standard.

| Polypeptide Sequence/Line | Driver | Target | Rosette $\delta^{13}C$ (per mil) |
|---|---|---|---|
| ERF054/Line 1 | RBCS4::LexA:GAL4_opLexA::GFP, Col_Wt | opLexA::G1845 | Increased (1.1‰) |
| ERF054/Line 2 | RBCS4::LexA:GAL4_opLexA::GFP, Col_Wt | opLexA::G1845 | Increased (1.1‰) |
| ERF054/Line 3 | RBCS4::LexA:GAL4_opLexA::GFP, Col_Wt | opLexA::G1845 | Increased (1.3‰) |
| ERF054/Line 4 | RBCS4::LexA:GAL4_opLexA::GFP, Col_Wt | opLexA::G1845 | Increased (2.0‰) |
| ERF054/Line 5 | RBCS4::LexA:GAL4_opLexA::GFP, Col_Wt | opLexA::G1845 | Increased (0.15‰) |

The results presented in Table 28 were determined after screening five independent transgenic events. Lines 1, 2 and 3 were screened twice and the effect size reported above is the mean of the two screening runs. The direction of the effect was the same in each screening run. Line 4 and 5 were screened once.

The present disclosure thus describes how the transformation of plants, which may include monocots and/or dicots, with an ERF015, AtbHLH031, NF-YC8, GATA4, WUS, ERF054, AMS, or WOX1 clade polypeptide can confer to the transformed plants greater photosynthetic resource use efficiency than the level of photosynthetic resource use efficiency exhibited by control plants. In one embodiment, expression of ERF015, AtbHLH031, NF-YC8, GATA4, WUS, ERF054, AMS, or WOX1 is driven by a constitutive promoter. In another embodiment, expression of ERF015, AtbHLH031, NF-YC8, GATA4, WUS, ERF054, AMS, or WOX1 is driven by a promoter with enhanced activity in a tissue capable of photosynthesis (also referred to herein as a "photosynthetic promoter" or a "photosynthetic tissue-enhanced promoter") such as a leaf tissue or other green tissue. Examples of photosynthetic tissue-enhanced promoters include for example, an RBCS3 promoter (SEQ ID NO: 520), an RBCS4 promoter (SEQ ID NO: 521) or others such as the At4g01060 (also referred to as "G682") promoter (SEQ ID NO: 522), the latter regulating expression in guard cells, or promoters listed in Table 4. Other photosynthetic tissue-enhanced promoters have been taught by Bassett et al., 2007. *BMC Biotechnol.* 7: 47, specifically incorporated herein by reference in its entirety. Other photosynthetic tissue-enhanced promoters of interest include those from the maize aldolase gene FDA (U.S. patent publication no. 20040216189, specifically incorporated herein by reference in its entirety), and the aldolase and pyruvate orthophosphate dikinase (PPDK) (Taniguchi et al., 2000. *Plant Cell Physiol.* 41:42-48, specifically incorporated herein by reference in its entirety). Other tissue enhanced promoters or inducible promoters are also envisioned that may be used to regulate expression of the disclosed clade member polypeptides and improve photosynthetic resource use efficiency in a variety of plants.

Example VI. Utilities of ERF015, AtbHLH031, NF-YC8, GATA4, WUS, ERF054, AMS, or WOX1 Clade Sequences for Improving Photosynthetic Resource Use Efficiency, Yield or Biomass By expressing the present polynucleotide sequences in a commercially valuable plant, the plant's phenotype may be altered to one with improved traits related to photosynthetic resource use efficiency or yield. The sequences may be introduced into the commercially valuable plant, by, for example, introducing the polynucleotide in an expression vector or cassette to produce a transgenic plant, or by crossing a target plant with a second plant that comprises said polynucleotide. The transgenic or target plant may be any valuable species of interest, including but not limited to a crop or model plant such as a wheat, *Setaria*, corn (maize), rice, barley, rye, millet, sorghum, turfgrass, sugarcane, miscane, turfgrass, *Miscanthus*, switchgrass, soybean, cotton, rape, oilseed rape including canola, *Eucalyptus*, or poplar plant. The present polynucleotide sequences encode an ERF015, AtbHLH031, NF-YC8, GATA4, WUS, ERF054, AMS, or WOX1 clade polypeptide sequence and the ectopic expression or overexpression in the transgenic or target plant of any of said polypeptides, for example, a polypeptide comprising any of SEQ ID NOs: 2, 62, 106, 138, 174, 204, 246, or 282, or SEQ ID NOs: 2n where n=1 to 164, or at least 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95% or 96%, 97%, 98%, 99%, or about 100% amino acid identity to any of SEQ ID NOs: 2, 62, 106, 138, 174, 204, 246, or 282, and/or SEQ ID NOs: 2n, where n=1 to 164, and/or at least 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95% or 96%, 97%, 98%, 99%, or about 100% amino acid identity to a domain of any of SEQ ID NOs: 329-510, and/or at least 90%, 91%, 92%, 93%, 94%, 95% m 96% m 97%, 98%, 99%, or about 100% identity to any of consensus sequences SEQ ID NOs: 511-519, can confer improved photosynthetic resource use efficiency or yield in the plant. For plants for which biomass is the product of interest, increasing the expression level of ERF015, AtbHLH031, NF-YC8, GATA4, WUS, ERF054, AMS, or WOX1 clade of polypeptide sequences may increase yield, light use efficiency, photosynthetic capacity, photosynthetic rate, photosynthetic resource use efficiency, vigor, and/or biomass as compared to a control plant of the plants. Thus, it is thus expected that these sequences will improve yield, light use efficiency, photosynthetic capacity, photosynthetic rate, photosynthetic resource use efficiency, vigor, and/or biomass as compared to a control plant in non-*Arabidopsis* plants relative to control plants. This yield improvement may result in yield increases of at least 1%, 2%, 3%, 4%, 5%, 6%, 7%, 8%, 9%, 10%, 11%, 12%, 13%, 14%, 15%, 16%, 17%, 18%, 19%, 20%, 25%, 30% or greater yield relative to the yield that may be obtained with control plants.

It is expected that the same methods may be applied to identify other useful and valuable sequences that are functionally-related and/or closely-related to the listed sequences or domains provided in the instant Tables, and the sequences may be derived from diverse species. Because of morphological, physiological and photosynthetic resource use efficiency similarities that may occur among closely-related sequences, the disclosed clade sequences are expected to increase yield, light use efficiency, photosynthetic capacity, photosynthetic rate, photosynthetic resource use efficiency, vigor, and/or biomass as compared to a control plant to a variety of crop plants, ornamental plants, and woody plants used in the food, ornamental, paper, pulp, lumber or other industries.

Example VII. Expression and Analysis of Increased Yield or Photosynthetic Resource Use Efficiency in Non-*Arabidopsis* or Crop Species Northern blot analysis, RT-PCR or microarray analysis of the regenerated, transformed plants may be used to show expression of a polypeptide or the instant description and related genes that are capable of inducing improved photosynthetic resource use efficiency, and/or larger size.

After a eudicot plant, monocot plant or plant cell has been transformed (and the latter plant host cell regenerated into a plant) and shown to have or produce increased yield, increased light use efficiency, increased photosynthetic capacity, increased photosynthetic rate, photosynthetic resource use efficiency, greater vigor, and/or greater biomass as compared to a control plant relative to a control plant, the transformed monocot plant may be crossed with itself or a plant from the same line, a non-transformed or wild-type monocot plant, or another transformed monocot plant from a different transgenic line of plants.

The function of one or more specific polypeptides of the instant description has been analyzed and may be further characterized and incorporated into crop plants. The ectopic overexpression of one or more of the disclosed clade polypeptide sequences may be regulated using constitutive, inducible, or tissue-enhanced regulatory elements. Genes that have been examined have been shown to modify plant traits including increasing yield and/or photosynthetic resource use efficiency. It is expected that newly discovered polynucleotide and polypeptide sequences closely related, as determined by the disclosed hybridization or identity analyses, to polynucleotide and polypeptide sequences found in the Sequence Listing can also confer alteration of traits in a similar manner to the sequences found in the Sequence Listing, when transformed into any of a considerable variety of plants of different species, and including dicots and monocots. The polynucleotide and polypeptide sequences derived from monocots (e.g., the rice sequences) may be used to transform both monocot and dicot plants, and those derived from dicots (e.g., the *Arabidopsis* and soy genes) may be used to transform either group, although it is expected that some of these sequences will function best if the gene is transformed into a plant from the same group as that from which the sequence is derived.

As an example of a first step to determine photosynthetic resource use efficiency, seeds of these transgenic plants may be grown as described above or methods known in the art.

Closely-related homologs of ERF015, AtbHLH031, NF-YC8, GATA4, WUS, ERF054, AMS, or WOX1 derived from various diverse plant species may be overexpressed in plants and have the same functions of conferring increased photosynthetic resource use efficiency. It is thus expected that structurally similar orthologs of the disclosed polypeptide clades, including SEQ ID NOs: 2n where n=1 to 161, orthologs that comprise any of consensus sequences SEQ ID NOs: 511-519, can confer increased yield, increased light use efficiency, increased photosynthetic capacity, increased photosynthetic rate, increased photosynthetic resource use efficiency, greater vigor, greater biomass, and/or size, relative to control plants. As at least one sequence of the instant description has increased photosynthetic resource use efficiency in Arabidopsis, it is expected that the sequences provided in the Sequence Listing, or polypeptide sequences comprising one of or any of the conserved domains provided in the instant Tables, will increase the photosynthetic resource use efficiency and/or yield of transgenic plants including transgenic non-*Arabidopsis* (plant species other than *Arabidopsis* species) crop or other commercially important plant species, including, but not limited to, non-*Arabidopsis* plants and plant species such as monocots and dicots, wheat, *Setaria*, corn (maize), teosinte (*Zea* species which is related to maize), rice, barley, rye, millet, sorghum, turfgrass, sugarcane, miscane, turfgrass, *Miscanthus*, switchgrass, soybean, cotton, rape, oilseed rape including canola, tobacco, tomato, tomatillo, potato, sunflower, alfalfa, clover, banana, blackberry, blueberry, strawberry, raspberry, cantaloupe, carrot, cauliflower, coffee, cucumber, eggplant, grapes, honeydew, lettuce, mango, melon, onion, papaya, peas, peppers, pineapple, pumpkin, spinach, squash, sweet corn, watermelon, rosaceous fruits including apple, peach, pear, cherry and plum, and brassicas including broccoli, cabbage, cauliflower, Brussels sprouts, and kohlrabi, currant, avocado, citrus fruits including oranges, lemons, grapefruit and tangerines, artichoke, cherries, endive, leek, roots such as arrowroot, beet, cassava, turnip, radish, yam, and sweet potato, beans, woody species including pine, poplar, *Eucalyptus*, mint or other labiates, nuts such as walnut and peanut. Within each of these species the closely-related homologs of ERF015, AtbHLH031, NF-YC8, GATA4, WUS, ERF054, AMS, or WOX1 may be overexpressed or ectopically expressed in different varieties, cultivars, or germplasm.

The instantly disclosed transgenic plants comprising the disclosed recombinant polynucleotides can be enhanced with other polynucleotides, resulting in a plant or plants with "stacked" or jointly introduced traits, for example, the traits of increased photosynthetic resource use efficiency and improved yield combined with an enhanced trait resulting from expression of a polynucleotide that confers herbicide, insect or and/or pest resistance in a single plant or in two or more parental lines. The disclosed polynucleotides may thus be stacked with a nucleic acid sequence providing other useful or valuable traits such as a nucleic acid sequence from *Bacillus thuringensis* that confers resistance to hemiopteran, homopteran, lepidopteran, coliopteran or other insects or pests.

Thus, the disclosed sequences and closely related, functionally related sequences may be identified that, when ectopically expressed or overexpressed in plants, confer one or more characteristics that lead to greater photosynthetic resource use efficiency. These characteristics include, but are not limited to, the embodiments listed below.

1. A dicot or monocot transgenic plant that has greater or increased photosynthetic resource use efficiency relative to a control plant;
   wherein the transgenic plant comprises an exogenous recombinant polynucleotide comprising a promoter selected from the group consisting of:
   a constitutive promoter, a non-constitutive promoter, an inducible promoter, a tissue-enhanced promoter, and a photosynthetic tissue-enhanced promoter;
   wherein the promoter regulates expression of a polypeptide having a percentage identity to an amino acid sequence comprising an ERF015, AtbHLH031, NF-YC8, GATA4, WUS, ERF054, AMS, or WOX1 clade polypeptide in a photosynthetic or green tissue of the transgenic plant;
   wherein the percentage identity is at least:
      26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95% or 96%, 97%, 98%, 99%, or about 100% identity to the entire length of any of SEQ ID NOs: 2n, where n=1-164; and/or
      at least 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95% or 96%, 97%, 98%, 99%, or about 100% identity to a domain of any of SEQ ID NOs: 329-510; and/or at least 77%, 78%, 79%, 80%, 81%, 82%, 83%, 84%, 85%, 86%, 87%, 88%, 89%, 90%, 91%, 92%, 93%, 94%, 95% or 96%, 97%, 98%, 99%, or about 100% identical to a consensus sequence of any of SEQ ID NO: 511-519; and/or the exogenous recombinant polynucleotide hybridizes with any of SEQ ID NO: 1, 41, 85, 107, 125, 155, 191, 245, 277, 317, 355, 387, 409, or 443 under stringent hybridization conditions followed by one, two, or more wash steps of 6×SSC and 65° C. for ten to thirty minutes per step;

wherein expression of the polypeptide under the regulatory control of the promoter confers greater or increased photosynthetic resource use efficiency in the transgenic plant relative to the control plant;

wherein the control plant does not comprise the recombinant polynucleotide; and/or 2. The transgenic plant of embodiment 1, wherein the photosynthetic tissue-enhanced promoter is an RBCS3 promoter, an RBCS4 promoter, an At4g01060 promoter, an Os02g09720 promoter, an Os05g34510 promoter, an Os11g08230 promoter, an Os01g64390 promoter, an Os06g15760 promoter, an Os12g37560 promoter, an Os03g17420 promoter, an Os04g51000 promoter, an Os01g01960 promoter, an Os05g04990 promoter, an Os02g44970 promoter, an Os01g25530 promoter, an Os03g30650 promoter, an Os01g64910 promoter, an Os07g26810 promoter, an Os07g26820 promoter, an Os09g11220 promoter, an Os04g21800 promoter, an Os10g23840 promoter, an Os08g13850 promoter, an Os12g42980 promoter, an Os03g29280 promoter, an Os03g20650 promoter, or an Os06g43920 promoter (SEQ ID NO: 862-888, respectively), or a functional variant thereof, or a functional fragment thereof, or a promoter sequence that is at least 80% identical to SEQ ID NO: 862-888; and/or 3. The transgenic plant of embodiments 1 or 2, wherein:
the recombinant polynucleotide encodes the polypeptide which comprises any of SEQ ID NOs: 2n, where n=1-241; and/or
any of SEQ ID NOs: 483, 490, 510, 538, 566, 588, 599, 608, 623, 629, 659, 686, 702, 721, 741, 760, 769, 786, 813; and/or
any of SEQ ID NO: 842-861; and/or 4. The transgenic plant of any of embodiments 1 to 3, wherein the polypeptide is encoded by
(a) the exogenous recombinant polynucleotide, or
(b) a second exogenous recombinant polynucleotide and expression of the polypeptide is regulated by a trans-regulatory element; and/or 5. The transgenic plant of any of embodiments 1 to 4, wherein a plurality of the transgenic plants have greater cumulative canopy photosynthesis than the canopy photosynthesis of the same number of the control plants grown under the same conditions and at the same density; and/or 6. The transgenic plant of any of embodiments 1 to 5, wherein the transgenic plant produces a greater yield than the control plant, including, but not limited to, a greater yield of: vegetative biomass, plant parts, whole plants, shoot vegetative organs/structures (for example, leaves, stems and tubers), roots, flowers and floral organs/structures (for example, bracts, sepals, petals, stamens, carpels, anthers and ovules), seed (including embryo, endosperm, and seed coat) and fruit (the mature ovary), plant tissue (for example, vascular tissue, ground tissue, pulped, pureed, ground-up, macerated or broken-up tissue, and the like) and cells (for example, guard cells, egg cells, and the like); and/or 7. The transgenic plant of any of embodiments 1 to 6, wherein the transgenic plant is selected from the group consisting of a corn, wheat, rice, *Setaria*, *Miscanthus*, switchgrass, ryegrass, sugarcane, miscane, barley, sorghum, turfgrass, soy, cotton, canola, rapeseed, *Crambe*, *Camelina*, sugar beet, alfalfa, tomato, *Eucalyptus*, poplar, willow, pine, birch and a woody plant; and/or 8. The transgenic plant of any of embodiments 1 to 7, wherein the transgenic plant is morphologically similar to the control plant at one or more stages of growth, and/or developmentally similar to the control plant.

9. A method for increasing photosynthetic resource use efficiency† in a dicot or monocot plant, the method comprising:

(a) providing one or more dicot or monocot plants that comprise an exogenous recombinant polynucleotide comprising a promoter selected from the group consisting of:
a constitutive promoter, a non-constitutive promoter, an inducible promoter, a tissue-enhanced promoter, and a photosynthetic tissue-enhanced promoter;

wherein the promoter regulates expression of a polypeptide having a percentage identity to an amino acid sequence comprising an ERF015, AtbHLH031, NF-YC8, GATA4, WUS, ERF054, AMS, or WOX1 clade polypeptide in a photosynthetic or green tissue of the dicot or monocot plant;

wherein the percentage identity is at least:
26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95% or 96%, 97%, 98%, 99%, or about 100% identity to the entire length of any of SEQ ID NOs: 2n, where n=1-241; and/or at least 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95% or 96%, 97%, 98%, 99%, or about 100% identity to a domain of any of SEQ ID NOs: 483 to 841; and/or at least 77%, 78%, 79%, 80%, 81%, 82%, 83%, 84%, 85%, 86%, 87%, 88%, 89%, 90%, 91%, 92%, 93%, 94%, 95% or 96%, 97%, 98%, 99%, or about 100% identical to a consensus sequence of any of SEQ ID NO: 842-861; and/or the exogenous recombinant polynucleotide hybridizes with any of SEQ ID NO: 1, 41, 85, 107, 125, 155, 191, 245, 277, 317, 355, 387, 409, or 443 under stringent hybridization conditions followed by one, two, or more wash steps of 6×SSC and 65° C. for ten to thirty minutes per step;

wherein expression of the polypeptide in the one or more dicot or monocot plants confers greater or increased photosynthetic resource use efficiency relative to a control plant that does not comprise the recombinant polynucleotide; and (b) growing the one or more dicot or monocot plants; and/or 10. The method of embodiment 9, wherein the photosynthetic tissue-enhanced promoter is an RBCS3 promoter, an RBCS4 promoter, an At4g01060 promoter, an Os02g09720 promoter, an Os05g34510 promoter, an Os11g08230 promoter, an Os01g64390 promoter, an Os06g15760 promoter, an Os12g37560 promoter, an Os03g17420 promoter, an Os04g51000 promoter, an Os01g01960 promoter, an Os05g04990 promoter, an Os02g44970 promoter, an Os01g25530 promoter, an Os03g30650 promoter, an Os01g64910 promoter, an Os07g26810 promoter, an Os07g26820 promoter, an Os09g11220 promoter, an Os04g21800 promoter, an Os10g23840 promoter, an Os08g13850 promoter, an Os12g42980 promoter, an Os03g29280 promoter, an Os03g20650 promoter, or an Os06g43920 promoter (SEQ ID NO: 862-888, respectively), or a functional variant thereof, or a functional fragment thereof, or a promoter sequence that is at least 80% identical to SEQ ID NO: 862-888; and/or 11. The method of embodiments 9 or 10, wherein an expression cassette comprising the recombinant polynucleotide is introduced into a target plant to produce the dicot or monocot plant comprising the exogenous recombinant polynucleotide; and/or 12. The method of any of embodiments 9 to 11, wherein the polypeptide is encoded by
(a) the exogenous recombinant polynucleotide, or
(b) a second exogenous recombinant polynucleotide and expression of the polypeptide is regulated by a trans-regulatory element; and/or 13. The method of any of embodiments 9 to 12, wherein the dicot or monocot plant is selected for having the increased photosynthetic resource use efficiency relative to the control plant; and/or 14. The method of any of embodiments 9 to 13, wherein the dicot or monocot plant produces a greater yield relative to the control plant; and/or 15. The method of any of embodiments 9 to 14, wherein the dicot or monocot plant is selected for having the greater yield relative to the control plant; and/or 16. The method of any of embodiments 9 to 15, wherein a plurality of the dicot or monocot plants have greater cumulative canopy photosynthesis than the canopy photosynthesis of the same number of the control plants grown under the same conditions and at the same density; and/or 17. The method of any of embodiments 9 to 16, wherein the dicot or monocot plant is selected from the group consisting of a corn, wheat, rice, Setaria, Miscanthus, switchgrass, ryegrass, sugarcane, miscane, barley, sorghum, turfgrass, soy, cotton, canola, rapeseed, Crambe, Camelina, sugar beet, alfalfa, tomato, Eucalyptus, poplar, willow, pine, birch and a woody plant; and/or 18. The method of any of embodiments 9 to 17, the method steps further including:
crossing the dicot or monocot plant with itself, a second plant from the same line as the dicot or monocot plant, a non-transgenic plant, a wild-type plant, or a transgenic plant from a different line of plants, to produce a transgenic seed.

19. A method for producing and selecting a dicot or monocot crop plant with greater yield or greater photosynthetic resource use efficiency[†] than a control plant, the method comprising:
(a) providing one or more dicot or monocot transgenic plants that comprise an exogenous recombinant polynucleotide comprising a promoter selected from the group consisting of:
a constitutive promoter, a non-constitutive promoter, an inducible promoter, a tissue-enhanced promoter, and a photosynthetic tissue-enhanced promoter;
wherein the promoter regulates expression of a polypeptide having a percentage identity to an amino acid sequence comprising an ERF015, AtbHLH031, NF-YC8, GATA4, WUS, ERF054, AMS, or WOX1 clade polypeptide in a photosynthetic or green tissue of the dicot or monocot transgenic plant;
wherein the percentage identity is:
at least 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95% or 96%, 97%, 98%, 99%, or about 100% identity to the entire length of any of SEQ ID NOs: 2n, where n=1-241; and/or
at least 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95% or 96%, 97%, 98%, 99%, or about 100% identity to a domain of any of SEQ ID NOs: 483 to 841; and/or
at least 77%, 78%, 79%, 80%, 81%, 82%, 83%, 84%, 85%, 86%, 87%, 88%, 89%, 90%, 91%, 92%, 93%, 94%, 95% or 96%, 97%, 98%, 99%, or about 100% identical to a consensus sequence of any of SEQ ID NO: 842-861; and/or
the exogenous recombinant polynucleotide hybridizes with any of SEQ ID NO: 1, 61, 105, 137, 173, 203, 245, or 281 under stringent hybridization conditions followed by one, two, or more wash steps of 6×SSC and 65° C. for ten to thirty minutes per step;
wherein the photosynthetic tissue-enhanced promoter does not regulate protein expression in a constitutive manner;
(b) growing a plurality of the dicot or monocot transgenic plants; and
(c) selecting a dicot or monocot transgenic plant that:
has greater photosynthetic resource use efficiency than the control plant, wherein the control plant does not comprise the recombinant polynucleotide; and/or
comprises the recombinant polynucleotide;
wherein expression of the polypeptide in the selected dicot or monocot transgenic plant confers the greater photosynthetic resource use efficiency or the greater yield relative to the control plant; and/or 20. The method of embodiment 19, the method steps further including:
(d) crossing the selected dicot or monocot transgenic plant with itself, a second plant from the same line as the selected transgenic plant, a non-transgenic plant, a wild-type plant, or a transgenic plant from a different line of plants, to produce a transgenic seed; and/or 21. The method of embodiment 19 or 20, wherein the dicot or monocot transgenic plant is selected for having the increased photosynthetic resource use efficiency relative to the control plant; and/or 22. The method of any of embodiments 19 to 21, wherein a plurality of the selected dicot or monocot transgenic plants have greater cumulative canopy photosynthesis than the canopy photosynthesis of the same number of the control plants grown under the same conditions and at the same density; and/or 23. The method of any of embodiments 19 to 22, wherein the selected dicot or monocot transgenic plant has an altered trait that confers the greater photosynthetic resource use efficiency.

24. A method for producing a dicot or monocot crop plant with greater photosynthetic resource use efficiency† than a control plant, the method comprising:
    (a) providing a dicot or monocot transgenic plant that comprises an exogenous recombinant polynucleotide that comprises a promoter selected from the group consisting of:
        a constitutive promoter, a non-constitutive promoter, an inducible promoter, a tissue-enhanced promoter, or a photosynthetic tissue-enhanced promoter;
        wherein the promoter regulates expression of a polypeptide comprising SEQ ID NO: 2, 62, 106, 138, 174, 204, 246, or 282 in a photosynthetic or green tissue of the transgenic plant to a level that is effective in conferring greater photosynthetic resource use efficiency in the transgenic plant relative to the control plant; and
    (b) measuring an altered trait that confers the greater photosynthetic resource use efficiency,
        wherein expression of the polypeptide in the selected dicot or monocot transgenic plant confers the greater photosynthetic resource use efficiency of the transgenic plant relative to the control plant, thereby producing the crop plant with greater photosynthetic resource use efficiency than the control plant; and/or 25. The method of embodiment 24, wherein the transgenic dicot or monocot plant is selected for having the increased photosynthetic resource use efficiency relative to the control plant.

26. A method for producing a monocot plant with increased grain yield, said method including:
    (a) providing a monocot plant cell or plant tissue with stably integrated, exogenous recombinant polynucleotide comprising a promoter (for example, a constitutive, a non-constitutive, an inducible, a tissue-enhanced, or a photosynthetic tissue-enhanced promoter) that is functional in plant cells and that is operably linked to an exogenous or an endogenous nucleic acid sequence that encodes a polypeptide that has a percentage identity to an amino acid sequence comprising an ERF015, AtbHLH031, NF-YC8, GATA4, WUS, ERF054, AMS, or WOX1 clade polypeptide, wherein the percentage identity is:
        at least 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95% or 96%, 97%, 98%, 99%, or about 100% identity to the entire length of any of SEQ ID NOs: 2n, where n=1-164; and/or
        at least 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95% or 96%, 97%, 98%, 99%, or about 100% identity to a domain of any of SEQ ID NOs: 329 to 510; and/or
        at least 77%, 78%, 79%, 80%, 81%, 82%, 83%, 84%, 85%, 86%, 87%, 88%, 89%, 90%, 91%, 92%, 93%, 94%, 95% or 96%, 97%, 98%, 99%, or about 100% identical to a consensus sequence of any of SEQ ID NO: 511-519; and/or
        the exogenous recombinant polynucleotide hybridizes with any of SEQ ID NO: 1, 61, 105, 137, 173, 203, 245, or 281 under stringent hybridization conditions followed by one, two, or more wash steps of 6×SSC and 65° C. for ten to thirty minutes per step;
    (b) generating a monocot plant from the plant cell or the plant tissue, wherein the monocot plant comprises the exogenous recombinant polynucleotide, wherein the polypeptide is expressed in a photosynthetic or green tissue of the monocot plant to a level that is effective in conferring greater photosynthetic resource use efficiency† in the monocot plant relative to a control plant that does not contain the recombinant polynucleotide;
    (c) growing the monocot plant; and
    (d) measuring an increase in photosynthetic resource use efficiency of at least 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24%, 25%, 26%, 2%, 28%, 29%, or 30% relative to the control plant, or an increase in grain yield of at least 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24%, 25%, 26%, 2%, 28%, 29%, or 30% or at least 1, 2, 3, 4, 5, 6, 7, 8, 9, 10, 11, 12, 13, 14, 15, 16, 17, 18, 19, 20 bushels per acre;
    thereby producing the monocot plant with increased grain yield relative to the control plant; and/or 27. The method of embodiment 26, wherein the ERF015, AtbHLH031, NF-YC8, GATA4, WUS, ERF054, AMS, or WOX1 clade polypeptide comprises a consensus sequence of one or more of any of SEQ ID NOs: 511-519; and/or 28. A transgenic monocot plant produced by the method of embodiment 26; and/or 29. The transgenic monocot plant of embodiment 28, wherein transgenic monocot plant is a corn, wheat, rice, *Miscanthus, Setaria*, switchgrass, ryegrass, sugarcane, miscane, barley, sorghum or turfgrass plant; and/or 30. The method of embodiment 26, wherein the promoter is an RBCS3 promoter, an RBCS4 promoter, an At4g01060 promoter, an Os02g09720 promoter, an Os05g34510 promoter, an Os11g08230 promoter, an Os01g64390 promoter, an Os06g15760 promoter, an Os12g37560 promoter, an Os03g17420 promoter, an Os04g51000 promoter, an Os01g01960 promoter, an Os05g04990 promoter, an Os02g44970 promoter, an Os01g25530 promoter, an Os03g30650 promoter, an Os01g64910 promoter, an Os07g26810 promoter, an Os07g26820 promoter, an Os09g11220 promoter, an Os04g21800 promoter, an Os10g23840 promoter, an Os08g13850 promoter, an Os12g42980 promoter, an Os03g29280 promoter, an Os03g20650 promoter, or an Os06g43920 promoter (SEQ ID NO: 520-546, respectively) or a Cauliflower Mosaic 35S promoter, or a functional variant thereof, or a functional fragment thereof, or a promoter sequence that is at least 80% identical to SEQ ID NO: 520-546; and/or 31. The method of embodiment 28, wherein the clade polypeptide comprises any of SEQ ID NO: 2, 62, 106, 138, 174, 204, 246, or 282.

† In the above embodiments 1, 9, 19, 24, and 26, greater photosynthetic resource use efficiency may be characterized by or measured as, but is not limited to, any one or more of following measurements or characteristics relative to a control plant. The measured or altered trait may be selected from the group consisting of:

(a) increased photosynthetic capacity, measured as an increase in the rate of light-saturated photosynthesis of at least 5%, 10%, 15%, 20%, 25%, 30%, 35%, or 40% when compared to the rate of light-saturated photosynthesis of a control leaf at the same leaf-internal $CO_2$ concentration. Optionally, measurements are made after 40 minutes of acclimation to a light intensity that is saturating for photosynthesis; and/or (b) increased photosynthetic rate, measured as an increase in the rate of light-saturated photosynthesis of at least 5%, 10%, 15%, 19%, 20%, 22%, 23%, 25%, 30%, 32%, 35%, or 40%. Optionally, measurements are made after 40 minutes of acclimation to a light intensity known to be saturating for photosynthesis; and/or (c) a decrease in the chlorophyll content of the leaf of at least 5%, 10%, 15%, 20%, 25%, 30%, 35%, or 40%, observed in the absence of a decrease in photosynthetic capacity; and/or (d) a decrease in the chlorophyll content of the leaf of at least 5%, 10%, 15%, 20%, 25%, 30%, 35%, or 40%, that would protect against photodamage during abiotic stress; and/or (e) a decrease in the percentage of the leaf dry weight that is nitrogen of at least 0.5%, 1.0%, 1.5%, 2.0%, 2.5%, 3.0%, 3.5%, or 4.0% observed in the absence of a decrease in photosynthetic capacity or increase in dry weight; and/or (f) increased transpiration efficiency, measured as an increase in the rate of light-saturated photosynthesis relative to water loss via transpiration from the leaf, of at least 5%, 10%, 15%, 20%, 25%, 30%, 35%, or 40%; optionally, measurements are made after 40 minutes of acclimation to a light intensity of 700 μmol PAR $m^{-2}$ $S^{-1}$; and/or (g) an increase in the resistance to water vapor diffusion out of the leaf that is exerted by the stomata, measured as a decrease in stomatal conductance to $H_2O$ loss from the leaf of at least 5%, 10%, 15%, 20%, 25%, 30%, 35%, or 40%; optionally, measurements were are after 40 minutes of acclimation to a light intensity of 700 μmol PAR m−2 s−1; and/or (h) a decrease in the resistance to carbon dioxide diffusion into the leaf that is exerted by the stomata, measured as an increase in stomatal conductance of at least 5%, 10%, 13%, 15%, 20%, 25%, 27%, 30%, 35%, 40%, 45%, 50%, 55%, 60%, 65%, or 68%; optionally, measurements were are after 40 minutes of acclimation to a light intensity of 700 μmol PAR m−2 s−1; and/or (i) a decrease in non-photochemical quenching of at least 2%, at least 3%, at least 4%, at least 5%, at least 6%, at least 7%, at least 8%, at least 9%, or at least 10%, for leaf measurements made after 40 minutes of acclimation to a light intensity of 700 μmol PAR $m^{-2}$ $s^{-1}$; and/or (j) an increase in non-photochemical quenching of at least 2%, at least 3%, at least 4%, at least 5%, at least 6%, at least 7%, at least 8%, at least 9%, or at least 10%, for leaf measurements made after 40 minutes of acclimation to a light intensity of 700 μmol PAR $m^{-2}$ $s^{-1}$ that would protect against photodamage during abiotic stress; and/or (k) a decrease in the ratio of the carbon isotope $^{12}C$ to $^{13}C$ found in either all the dried above-ground biomass, or specific components of the above-ground biomass, e.g., leaves or reproductive structures, of at least 0.5 ‰ (0.5 per mille), or at least 1.0 ‰, 1.5 ‰, 2.0‰, 2.5‰, 3.0‰, 3.5‰, or 4.0‰ measured as a decrease in the ratio of $^{12}C$ to $^{13}C$ relative to the controls with both ratio being expressed relative to the same standard; and/or (l) an increase in the total dry weight of above-ground plant material of at least 5%, 10%, 15%, 20%, 23%, 25%, 30%, 32%, 35%, 40%, 45%, 50%, 55%, 60%, 65%, 70%, or 75%.

All publications and patent applications mentioned in this specification are herein incorporated by reference to the same extent as if each individual publication or patent application was specifically and individually indicated to be incorporated by reference.

The present invention is not limited by the specific embodiments described herein. The invention now being fully described, it will be apparent to one of ordinary skill in the art that many changes and modifications can be made thereto without departing from the spirit or scope of the appended claims. Modifications that become apparent from the foregoing description and accompanying figures fall within the scope of the claims.

SEQUENCE LISTING (546 sequences)

SEQ ID NO: 1 - DNA, 561 bp, Arabidopsis thaliana
  AT4G31060.1
atgccaccctctcctcctaaatctccttttattagctcttcactcaaaggagctcatgaagatcgcaaatttaaatgctataggggtgtccgaaagaggtcttggggcaaatgggtgtctgaaatcagagttccaaagactggacgacgaatatggctaggttcatacgatgctccagagaaggcagctagagcctatgatgctgctttgttctgtattaggggtgagaagggagtttacaattttcccactgataaaaagccgcagcttccagaaggttctgtccggcctctgtccaagctcgacatacagacaatagcaacaaactatgcttcatcagttgtgcatgtaccttcccatgccaccacactcccggcaacaacccaggttccctctgaagttcctgcttcctctgatgtttctgcttctactgagattacagagatggtcgatgaatattatctcccaaccgatgcaactgcagaatcaatattctcagttgaagacttacaactggacagtttcctcatgatggacattgattggataaacaatctaatc

SEQ ID NO: 2 - protein, 187 aa, Arabidopsis thaliana
  AT4G31060.1
MPPSPPKSPFISSSLKGAHEDRKFKCYRGVRKRSWGKWVSEIRVPKTGRRIWLGSYDAPEKAARAYDAALFCIRGEKGVYNFPTDKKPQLPEGSVRPLSKLDIQTIATNYASSVVHVPSHATTLPATTQVPSEVPASSDVSASTEITEMVDEYYLPTDATAESIFSVEDLQLDSFLMMDIDWINNLI

SEQ ID NO: 3 - DNA, 534 bp, Populus trichocarpa
  POPTR_0006s08000.1
atggatccctgtaagtcctctgctcctcctaagaaagttcgacaagggagaaattcgggaacttacaggggtgtcagaatgaggacatggggcaaatgggtttctgaaataagggttccgaagactggacaaaggatatggctgggttcttatgatgccccagagaaagcagctcgagcatatgatgctgcccagtattgtattcgtggtgaacgtgggcaattcaattttcctgctgaaagaaggccacaacttcctagtggtccagtagatgccttgtccaagaaggaaataaaggctattgcctttaactttgcttcgtcaaatgcatcatcagtgtctccctctgtgataactccggtggaaatggttgaaccatccttgcccaatttgcaggtttcaagtgcaactggaaatgcaggtaatgtggagggttatgttccagctagtgcgtcagtaccagatttatgttcaatagacaatttacagttggatgatttactcatgctggacatagaatggatagactccctc

SEQ ID NO: 4 - protein, 178 aa, Populus trichocarpa
  POPTR_0006s08000.1
MDPCKSSAPPKKVRQGRNSGTYRGVRMRTWGKWVSEIRVPKTGQRIWLGSYDAPEKAARAYDAAQYCIRGERGQFNFPAERRPQLPSGPVDALSKKEIKAIAFNFASSNASSVSPSVITPVEMVEPSLPNLQVSSATGNAGNVEGYVPASASVPDLCSIDNLQLDDLLMLDIEWIDSL

SEQ ID NO: 5 - DNA, 573 bp, Vitis vinifera
  GSVIVT01035502001
atggtaaagccgaccgccgcaacagccaccactacctccgaagggggacagccggggaactcggagacgaaatacaagggagtgcggaagaggaaatgggggaagtgggtgtcagaaatacggctccccaacagccgagagaggatttggctgggctcctacgacacgccagagaaggcggcgcgggcattcgacgctgccctcttttgtctccgcggccacggcgccaagttcaacttccccgacaaccctccggatatccccggtcgggagtctctcactccctcggagatccaactggtcgccgcgagattcgccaacgaagaaccgccgaaagaatgctcggagttggagtcgcagcactcgcagtcggagtcgcaccactacaactacacgccgtcttgttcgttgtcggaacagttggagaacgaaacgataatggacggatcgttttggagcataagggactacagctatatcgatggcggtggactcgggatttctccgccaagcccgatggatgagagtggcggcgaagagttttttcagcagtcgtcattcctctggaacttc

SEQ ID NO: 6 - protein, 191 aa, Vitis vinifera
  GSVIVT01035502001
MVKPTAATATTTSEGGQPGNSETKYKGVRKRKWGKWVSEIRLPNSRERIWLGSYDTPEKAARAFDAALFCLRGHGAKFNFPDNPPDIPGRESLTPSEIQLVAARFANEEPPKECSELESQHSQSESHHYNYTPSCSLSEQLENETIMDGSFWSIRDYSYIDGGGLGISPPSPMDESGGEEFFQQSSFLWNF

SEQ ID NO: 7 - DNA, 744 bp, Solanum lycopersicum
  Solyc12g009240.1.1
atggtgaaacccaattcgaaagatactgaattttcacagtcgtcatcgtcgtcgttgtatcggggagtacggaagaggaaatgggggaaatgggtatcggaaattagattacctaatagtagagaaaggatttggttgggttcttatgatacgccggaaaaagctgctaaagcatttgacgccgcacttttttgtttgcggggtaaaggggctaatttcaatttcccggaaaatccgccggagattaggaacggaaggacgatgactccgtcggagattcaatcggcggcggcgcagtttgcgaataatacagaacccgaacttatccgggtcgggccaagggagaattcggatctttcttcttcctcatcggaaatatttcgagcggaatcaccgtcggtgtcagtttccgatagagtagaaagtgaaaagacggaaataaccttgggtaacgattttatcgatgtgtatcgggtggagtctagagtggaaagtgaaaagacggaaatgtccttggataacggatttgttgacatgttttcgtcgttaggaacggttaatgatatgtctgattttggaatttttccggggttcgatgacttatcgggtgaattttttataccaccaccatcgtcaccacaaccatcaccactgcaaatgcctaatttggaatcattagaagaagagaattatttgaactatgatggatttcaatcacaggggacttcatttctttggaatttt

SEQ ID NO: 8 - protein, 248 aa, Solanum lycopersicum
  Solyc12g009240.1.1
MVKPNSKDTEFSQSSSSSLYRGVRKRKWGKWVSEIRLPNSRERIWLGSYDTPEKAAKAFDAALFCLRGKGANFNFPENPPEIRNGRTMTPSEIQSAAAQFANNTEPELIRVGPRENSDLSSSSSEIFRAESPSVSVSDRVESEKTEITLGNDFIDVYRVESRVESEKTEMSLDNGFVDMFSSLGTVNDMSDFGIFPGFDDLSGEFFIPPPSSPQPSPLQMPNLESLEEENYLNYDGFQSQGTSFLWNF

SEQ ID NO: 9 - DNA, 585 bp, Arabidopsis thaliana
  AT1G74930.1
atggtgaagcaagcgatgaaggaagaggagaagaagagaaacacggcgatgcagtcaaagtacaaaggagtgaggaagaggaaatggggaaaatgggtatcggagatcagacttccacacagcagagaacgaatttggttaggctcttacgacactcccgagaaggcggcgcgtgctttcgacgccgctcaattttgtctccgcggcggcgatgctaatttcaatttccctaataatccaccgtcgatctccgtagaaaagtcgttgacgcctccggagattcaggaagctgctgctagattcgctaacacattccaagacattgtcaagggagaagaagaatcgggtttagtacccggatccgagatccgaccagagtctccttctacatctgcatctgttgctacatcgacggtggattatgatttttcgtttttggatttgcttccgatgaatttcgggtttgattccttctccgacgacttctctggcttctccggtggtgatcgatttacagagattttacccatcgaagattacggaggagagagtttattagatgaatctttgattctttgggatttt

SEQ ID NO: 10 - protein, 195 aa, Arabidopsis thaliana
  AT1G74930.1
MVKQAMKEEEKKRNTAMQSKYKGVRKRKWGKWVSEIRLPHSRERIWLGSYDTPEKAARAFDAAQFCLRGGDANFNFPNNPPSISVEKSLTPPEIQEAAARFANTFQDIVKGEEESGLVPGSEIRPESPSTSASVATSTVDYDFSFLDLLPMNFGFDSFSDDFSGFSGGDRFTEILPIEDYGGESLLDESLILWDF

SEQ ID NO: 11 - DNA, 555 bp, Arabidopsis thaliana
  AT1G19210.1
atggaagggtcgtcttcttcgatgcagtcaaagtacaaaggagtgaggaagaggaaatggggaaaatgggtttcagagatcagacttcccaacagcagagaacgtatttggttgggctcttacgatactcctgagaaggcggcgcgtgctttcgacgcggctctttattgtctccgtggcaacaacgcaaagttcaatttccctgataatcctccggtgatctccggcggacgtaacttgtcgcgatctgagataagagaagctgctgcgaggttcgctaattcggcggaggatgattcaagtggcggagcaggatacgagatacggcaagaatctgcttcaacatcgatggacgttgattcggagtttttgagtatgcttccgacggttggttcgggtaacttcgcttcggagtttgggttattccctgggtttgatgatttctccgatgaatactccggtgatcgtttcagagagcagctttcgcctacacaagattattatcagcttggagaagagacttacgccgatggttccatgtttctttggaatttt

SEQ ID NO: 12 - protein, 185 aa, Arabidopsis thaliana
  AT1G19210.1
MEGSSSSMQSKYKGVRKRKWGKWVSEIRLPNSRERIWLGSYDTPEKAARAFDAALYCLRGNNAKFNFPDNPPVISGGRNLSRSEIREAAARFANSAEDDSSGGAGYEIRQESASTSMDVDSEFLSMLPTVGSGNFASEFGLFPGFDDFSDEYSGDRFREQLSPTQDYYQLGEETYADGSMFLWNF

SEQ ID NO: 13 - DNA, 618 bp, Populus trichocarpa
  POPTR_0006s23480.1
atggtgagacctggaacgtcatcttcgtcagtgtcatctgagcaacagtctgatagaacacatgagcccaagtacaagggtgttcgaaagagaaaatggggtaagtgggtgtctgaaattaggctgcctaatagccgggagagaatatggttaggatcctatgacacgcccgaaaaggcggcgcgtgcatttgacgctgccctgtattgcctacgtggtagtggtgccaagttcaatttccctgacaacccaccggacattgtcggcgggcggtcacttaccccgcaagaggtgcaagaagttgctgccaggtttgctaatgaagagccaacatcgtccactgctatgggaggtgaatcatcgtcacatgtggagaattacacatcatcatcgtccgactgtggggctggacaaatggatagtgatactatagactggtcgtttttgaatttgttggattctaatgagggtgcatccgatttcggactctatcacgggctggaccatatgggtggtgattattatccccctcctactccgccgccgcctcctgattataacggggatgataacaacggagacgaaactttctctcaccagtcatttctttggaacttt

SEQ ID NO: 14 - protein, 206 aa, Populus trichocarpa
  POPTR_0006s23480.1
MVRPGTSSSSVSSEQQSDRTHEPKYKGVRKRKWGKWVSEIRLPNSRERIWLGSYDTPEKAARAFDAALYCLRGSGAKFNFPDNPPDIVGGRSLTPQEVQEVAARFANEEPTSSTAMGGESSSHVENYTSSSSDCGAGQMDSDTIDWSFLNLLDSNEGASDFGLYHGLDHMGGDYYPPPTPPPPPDYNGDDNNGDETFSHQSFLWNF

SEQ ID NO: 15 - DNA, 549 bp, Glycine max
  Glyma04g06100.1
ttatacaaaggggtgagaaagcgaaagtgggggaaatgggtttctgaaataaggcttcccaatagccgtgaacgcatatggctagggtcttatgactctcctgaaaaagcagcgcgagccttcgatgctgccctttactgtctacgtggccgccatgccaatttcaatttccccaacacaccttgcaacatggacactaccaatgctcctcaccaatctcttaccccacaagagattcaagaggttgctgctaatttcgcaaaccaggccccactactacaaaaacctcaagaaccattggaatacaagtgtgagatgaagtgggggtggtgtactaatactacttgtacccccaccaccactgcctcgtcatgttctactactatgtatgaatgtgatggaacggtgcaagtggaccatggggacatggattggacattcttgaacgtatttgattattccaatgagggttacgaacaattaattgaagctgatcatgatgatgatgaccctttttctcaccaatcattcctttggaattggaacttt

SEQ ID NO: 16 - protein, 183 aa, Glycine max
  Glyma04g06100.1
LYKGVRKRKWGKWVSEIRLPNSRERIWLGSYDSPEKAARAFDAALYCLRGRHANFNFPNTPCNMDTTNAPHQSLTPQEIQEVAANFANQAPLLQKPQEPLEYKCEMKWGWCTNTTCTPTTTASSCSTTMYECDGTVQVDHGDMDWTFLNVFDYSNEGYEQLIEADHDDDDPFSHQSFLWNWNF

SEQ ID NO: 17 - DNA, 702 bp, Glycine max
  Glyma06g06100.1
tgtggtccaccaacgagacatgagctcagaaccgaaaggaggaagagccatgttaatttgcatgtcaacttatacaaaggggtgagaaagcgaaagtgggggaaatgggtttctgaaatcaggcttcccaatagccgtgaacgaatatggctagggtcttatgactctcctgaaaaggcagcacgagccttcgatgctgccctttactgtctacgtggccgccatgccaatttcaatttccccaacacaccttgcaacatggacactgctaccaatgctcctcctaaccaatctcttaccccacaagagattcaagaggttgctgctaagttcgcaaatcagcaagtggaccgtggggacatgatggattggacattcttgaacgtctttgatttctccaatgaggtggtgcttcctgctgttggatccgactataatgatctctataattctgagctacacaagatgcactcagattcagtatataacaataacaaggacaagacaagacacaggctatgtcagaccatatatatattccttaccataattaagtatatgcctagctatatggctagctatatatatatattgatctgtgacatgtatcccttctcctttccttatttctctgtaaaattaaatcttagtggatttgcagtgcttaattttcttgtgcacaaatgtgctatagctctaaag

SEQ ID NO: 18 - protein, 234 aa, Glycine max
  Glyma06g06100.1
CGPPTRHELRTERRKSHVNLHVNLYKGVRKRKWGKWVSEIRLPNSRERIWLGSYDSPEKAARAFDAALYCLRGRHANFNFPNTPCNMDTATNAPPNQSLTPQEIQEVAAKFANQQVDRGDMMDWTFLNVFDFSNEVVLPAVGSDYNDLYNSELHKMHSDSVYNNNKDKTRHRLCQTIYIFLTIIKYMPSYMASYIYILICDMYPFSFPYFSVKLNLSGFAVLNFLVHKCAIALK

SEQ ID NO: 19 - DNA, 594 bp, Glycine max
  Glyma17g05240.1
atggcgaaacccagcagcgaaaagccagaggagcatagcgattccaagtactacaaaggggtccgaaagagaaaatggggcaaatgggtatccgaaataagactacccaacagccgtcagaggatttggttgggatcctacgacacccccgagaaggccgcgcgtgccttcgacgcggcaatgttctgcttacgtggccgcaacgccaagtttaatttccccgacaacccacccgacatcgccggcggaacgtccatgacgccgtcgcagattcagatcgccgccgcacaattcgccaacgcggggccccacgagggacattcgggtcgacccgaacatcctcccatggaatctccatcgccttctgtttcggaagggaccatccaaacggacagtgacgtccccactcttaacggttcagtaacggatttgttcacgcccgttgggtcgagtggttacgcatccgattacgggattttcccgggctttgatgatttcagtggcgatttttatgtgccggaaatgccgaacgttaattatggagaagaaaacggggaagggttcatagttgatgaatctttcttgtggaatttt

SEQ ID NO: 20 - protein, 198 aa, Glycine max
  Glyma17g05240.1
MAKPSSEKPEEHSDSKYYKGVRKRKWGKWVSEIRLPNSRQRIWLGSYDTPEKAARAFDAAMFCLRGRNAKFNFPDNPPDIAGGTSMTPSQIQIAAAQFANAGPHEGHSGRPEHPPMESPSPSVSEGTIQTDSDVPTLNGSVTDLFTPVGSSGYASDYGIFPGFDDFSGDFYVPEMPNVNYGEENGEGFIVDESFLWNF

SEQ ID NO: 21 - DNA, 756 bp, Vitis vinifera
  GSVIVT01015037001
atgtctatttcagaggttttcgaaattgagtcacatggaagtgaagacgcaccaacacgcctgttgggtgttgacccacctcatcatataaatacgagccgtcactcccaaactcagcaaaactacactcagatactcgaacaaaatccgatttgctcgaaagagatattggggacttgccaaaatcggaacctgaggataaggacaaggacagaaatggtgaagaaggcgatcggagtaggatcagccccggcggagagcagcgattgcaggtacaagggagtgaggaagcggaagtgggggaagtgggtgtcggagattaggcttcccaacagccgcgagcggatctggttggggtcctacgacacggcggagaaggccgcaagggccttcgacgccgctctctactgcctccgtggccgcacagcgaagttcaactttccggagaatccgccgaagatcgccggcggaggatccctcactaggtcggagattcgagcggcagccgccaaattcgcaaatgaggactcttccactgcctcgaccagccactccatcagaattcattattttcaaccattcgttttcccggaaatatttttgattccgggaaagggatcggattcgatggctagttttagtacagcctctacttgccttggtatattctttcccgtgtcaccttccattcaattgttatcagaaaatatgagagccgcggattttgtgattttctcttctttaatgcaaacatat

SEQ ID NO: 22 - protein, 252 aa, Vitis vinifera
  GSVIVT01015037001
MSISEVFEIESHGSEDAPTRLLGVDPPHHINTSRHSQTQQNYTQILEQNPICSKEILGTCQNRNLRIRTRTEMVKKAIGVGSAPAESSDCRYKGVRKRKWGKWVSEIRLPNSRERIWLGSYDTAEKAARAFDAALYCLRGRTAKFNFPENPPKIAGGGSLTRSEIRAAAAKFANEDSSTASTSHSIRIHYFQPFVFPEIFLIPGKGSDSMASFSTASTCLGIFFPVSPSIQLLSENMRAADFVIFSSLMQTY

SEQ ID NO: 23 - DNA, 642 bp, Glycine max
  Glyma09g08330.1
atggtgaagccgaagagcgtggagaaacccgcagaggaacaacaacaacgaagtgtttcatcgtacagaggagtacggaagaggaagtgggggaagtacgtgtcggaaattaggttacccaacagccgtcaaaggatttggttgggttcctatgacagcgccgagaaggcggcacgcgcgttcgacgctgccatgttctgcttacgtggcagcggcgccaaatttaatttcccgagtgacccacccaacatcgccggcggggggaacatgacctcctcccagattcagatcgcggcggcgcgtttcgccaattcggagccccgaaatgagcgttcggatcaacccgtggagtctttaacttcggatgaggaaacggcatcgtttccggtcatttcggatacggatacatcatctcctcctctctcagacgtgacgttccaaaacgacgccgaattagttactgggtcgttccctgatatgttttcggatttcgggtcgggcgattttgtgcccgatttctccgattttccgagcttcgacgatttcagccgggacttcttcttgcatgaacttccgggtttcaatttcggagaagagaacttggatggattgataattcaggactcgttcttgtggaatttc

SEQ ID NO: 24 - protein, 214 aa, Glycine max
  Glyma09g08330.1
MVKPKSVEKPAEEQQQRSVSSYRGVRKRKWGKYVSEIRLPNSRQRIWLGSYDSAEKAARAFDAAMFCLRGSGAKFNFPSDPPNIAGGGNMTSSQIQIAAARFANSEPRNERSDQPVESLTSDEETASFPVISDTDTSSPPLSDVTFQNDAELVTGSFPDMFSDFGSGDFVPDFSDFPSFDDFSRDFFLHELPGFNFGEENLDGLIIQDSFLWNF

SEQ ID NO: 25 - DNA, 594 bp, Populus trichocarpa
  POPTR_0018s08320.1
atggtaaaaccatcatcgtcatcagggcaacagtctgatagaaatcatgagcccaagtacaagggtgttagaaagagaaagtgggggaagtgggtgtccgaaatcagactacccaatagtcgggagagaatatggttaggatcttatgacacgcccctaaaagcggcgcgtgcattcgacgcagccttgtattgtttacgtggtagcggtgccaagtttaatttccccgacaatccaccggacattgttggtgggcagtcacttagttcgcaagaaatacaagaagttgctgccaggtttgctaatgaggagccaacatcgtcgtcgactgctacgagaggtgaatcatcagaacatgtggagaatgacacatcatcgtcgtctgatggtggagctggagatactatagattggtcgtttttgaacttgttggattctagcgagggtgcttcagattttggactctatcatgggctggaccatatgggtggtgattattatccaccaccaccgcctccgtctgaatatagcatcggtggggatgatcacaatggagatgaagcttactctcaacagtcatttctttggaacttt

SEQ ID NO: 26 - protein, 198 aa, Populus trichocarpa
  POPTR_0018s08320.1
MVKPSSSSGQQSDRNHEPKYKGVRKRKWGKWVSEIRLPNSRERIWLGSYDTPLKAARAFDAALYCLRGSGAKFNFPDNPPDIVGGQSLSSQEIQEVAARFANEEPTSSSTATRGESSEHVENDTSSSSDGGAGDTIDWSFLNLLDSSEGASDFGLYHGLDHMGGDYYPPPPPPSEYSIGGDDHNGDEAYSQQSFLWNF

SEQ ID NO: 27 - DNA, 627 bp, Populus trichocarpa
  POPTR_0006s14100.1
atggtgaagcacagcgtcgagaagccagttgcagagagaagcgactcaaaattcaagggtgttaggaaaagaaaatggggtaagtgggtgtcagaaatcaggctaccgaatagccgggaaagaatttggttagggtcgtatgattctgcagaaaaggccgcacgagccttcgatgccgcccttttctgcttacgcggtcgagttgcgaaatttaattttccggagaaccctccaaacatagcgggtggcaggtcactttctccagctgagattcaagaagctgcagcaaggtttgccaattcggagcctcagagaagccaaccggaccggtttgaaacagatcaatccgtatctgtatccgaatctcgagcagaatctccctgtccttcggttgtatctgatgggactgtccagatggaaggtggtgaattgatgtgggatgggccgtttttggatatgttaatgaatacgggttcgtgtaatcactccacggaatatgggatatttcagggttttgatgatctttacagtgattttttcccaccatcattaattcctaatcttgattatggagaggagaccaatcttgatggtgtcttagaacaaggttcgtttctttggaatttc

SEQ ID NO: 28 - protein, 209 aa, Populus trichocarpa
  POPTR_0006s14100.1
MVKHSVEKPVAERSDSKFKGVRKRKWGKWVSEIRLPNSRERIWLGSYDSAEKAARAFDAALFCLRGRVAKFNFPENPPNIAGGRSLSPAEIQEAAARFANSEPQRSQPDRFETDQSVSVSESRAESPCPSVVSDGTVQMEGGELMWDGPFLDMLMNTGSCNHSTEYGIFQGFDDLYSDFFPPSLIPNLDYGEETNLDGVLEQGSFLWNF

SEQ ID NO: 29 - DNA, 597 bp, Glycine max
  Glyma13g17250.1
atgatggtgaagccgagtagcgaaaagccagaggagcatagggattccaagtactacaaaggggtccgaaagagaaaatggggcaaatgggtatccgaaataagactacccaacagccgtcagaggatttggttgggatccttcgacacccccgagaaggccgcgcgtgccttcgacgccgcaatgttctgcttacgtggccgcaacgccaagttcaatttccccgacaacccacccgacatcgccggcggggaatccatgacgccgtcacagattcaggtcgccgccgcacaattcgccaacgctgggccccacgagggacattcgggtcgacccgaacattctcccatgcaatctctatcgccttctgtttcagaagggaccgttctaacggacagtgacgtcaccacacttaacggttcgctaacggatttgttcactcccgttgggtcgagtggttacgcatccgattacgggattttccccggtgttgatgatttcagtggcggtttttatgtgccggaaatgctgaactttaattatggagaagaaaacggggaagggttcatagttgatgagtctttcttgtggaatttt

SEQ ID NO: 30 - protein, 199 aa, Glycine max
  Glyma13g17250.1
MMVKPSSEKPEEHRDSKYYKGVRKRKWGKWVSEIRLPNSRQRIWLGSFDTPEKAARAFDAAMFCLRGRNAKFNFPDNPPDIAGGESMTPSQIQVAAAQFANAGPHEGHSGRPEHSPMQSLSPSVSEGTVLTDSDVTTLNGSLTDLFTPVGSSGYASDYGIFPGVDDFSGGFYVPEMLNFNYGEENGEGFIVDESFLWNF

SEQ ID NO: 31 - DNA, 702 bp, Zea mays
  GRMZM2G097081_T01
atgtcgtcgtcgccggagacagaggccgccgggagcagcagcagcagcaggaagttcaagggcgtgcggaagcgcaagtggggcaagtgggtgtctgagatccggctacccaacagccgcgagcgtatctggctgggctcctacgacgcccccgacaaggccgcgcgcgccttcgacgccgccttcgtctgcctccgcggccgcggcgccgccggcgcggacctcaacttcccggactcgccgccgccgtgccgcgcgggggggtgcagcagcgacccgcgggaggtgcaggcggccgcgctctcccacgccaaccgcgccgccgtcacggcccagcaggcggccgccgcgctcaccatggacggcggcggcgccgatggctcggcgccgccatgggactactactactactactccgtggcgcacgacgcgggcggcgtccttggtggcgctgcagctaccagcagcacggcggaggtggtggcgcccgtgcgcgccgacgggagcatcgactggcggcccgttatggcgcacccgccgccgctcttctcccctaccggctggggcagcaatgcgtacgacttcctgcaggtgccaccgccgccggcggctgtggccgacgaggacatgcttgatgacggtgtccatggcgcaaccgcttctctctggagcttcgactcgagagactcctacttcagatac

SEQ ID NO: 32 - protein, 234 aa, Zea mays
  GRMZM2G097081_T01
MSSSPETEAAGSSSSSRKFKGVRKRKWGKWVSEIRLPNSRERIWLGSYDAPDKAARAFDAAFVCLRGRGAAGADLNFPDSPPPCRAGGCSSDPREVQAAALSHANRAAVTAQQAAAALTMDGGGADGSAPPWDYYYYYSVAHDAGGVLGGAAATSSTAEVVAPVRADGSIDWRPVMAHPPPLFSPTGWGSNAYDFLQVPPPPAAVADEDMLDDGVHGATASLWSFDSRDSYFRY

SEQ ID NO: 33 - DNA, 621 bp, Oryza sativa
  LOC_Os06g09717.1
atgtcgtcgtcgtcttcggcgacgacgacgaagtataggggagtgcggctgcgcaagtgggggaagtgggtgtcggagatccggctgcccaacagccgcgagaggatatggctgggatcctacgacacgcccgaggaggcggcgcgggcgttcgacgccgcgttcgtctgcctccgcggcggcggcgaggccgccgggaacgggatcaacttccccggctcgccccctgccgtggcgcgcaccagcgacccgcaggaggtgtacgcggccgcggtgtcgcatgccaacaaccggccgccgccgccgccgtcggcccgagcaacgtcgtctgcacttccatgggaggaagctccggtggtggcggctcaggaggcggcggcggacatggcgcccgacgtggtggtgctgccatcgtcgccggtgaatgtgctggcagcagctgggagcttcgaatattggtcgcaacaaccactctactcgccgacggcagcaagcctcgatttgcagaggtggatgacggcggcggcggcggccgaggaatcaataatggaggatgacgacgacgaaggaacaagtgatggtctttggagtttccactactcaccgactcgttccaagtgg

SEQ ID NO: 34 - protein, 207 aa, Oryza sativa
  LOC_Os06g09717.1
MSSSSSATTTKYRGVRLRKWGKWVSEIRLPNSRERIWLGSYDTPEEAARAFDAAFVCLRGGGEAAGNGINFPGSPPAVARTSDPQEVYAAAVSHANNRPPPPPSARATSSALPWEEAPVVAAQEAAADMAPDVVVLPSSPVNVLAAAGSFEYWSQQPLYSPTAASLDLQRWMTAAAAAEESIMEDDDDEGTSDGLWSFHYSPTRSKW

SEQ ID NO: 35 - DNA, 372 bp, Oryza sativa
  LOC_Os06g09760.1
atgctgctcccccgaacagactgccaggccaacggtacgtcgccggcgccagtggagaggaagtacaggggcgtgcggctgcggcagtgggggaagtgggtggcggagattcggctgcccaacagcctcaagaggatatggctgggatcctacgactcgccggagaaggcggcgcgggcgttcgacgccgccttcatctgtctccgcggcggcgaggccatcgccggcctcaacttccccgagtcgccgcccaccgtcgttgcccgcactagcgacccgcgggaggtgctcgcctacgcgacgtcgcatgctaaccggctgggatgccaccattgcacaggaagaagcagctctggtggaggaggagacggc

SEQ ID NO: 36 - protein, 124 aa, Oryza sativa
  LOC_Os06g09760.1
MLLPRTDCQANGTSPAPVERKYRGVRLRQWGKWVAEIRLPNSLKRIWLGSYDSPEKAARAFDAAFICLRGGEAIAGLNFPESPPTVVARTSDPREVLAYATSHANRLGCHHCTGRSSSGGGGDG

SEQ ID NO: 37 - DNA, 603 bp, Populus trichocarpa
  POPTR_0006s14090.1
atggtgaagttcaatacagagaagccagttgcagagagaagtgactcaaaatacaagggtgttagaaaaagaaaatggggccggtgggtgtctgaaatcaggctaccgaatagccgggaaagaatttggttaggatcatatgattcggctgaaaaagcagcacacgctttcgacgcagcccttttctgcttgcgcggcaacacaatgaagtttaatttttcggagaaccctccaaacatagcaggtggcggctcactttctccctctgagattcaagaagctgccgcgaggtttgccaattcggagccccaaagaggccaatccggtaagctcgaggcggatcaatccacatctgtgtccgaatctcgaccggaatcaccttgtctttcggcagcatcagatggtactgtccgagacatgccattttttgatatggcaatgagtacaagttcgagtaatcaccccacagagtatgggatatttccgggttttgacgatcttcacagtggtttttttgcgccatcatttttacccaatcttgatcatggagaggggttcaatctcgatggtgttttggaagaagattcgtttctttggaatttc

SEQ ID NO: 38 - protein, 201 aa, Populus trichocarpa
  POPTR_0006s14090.1
MVKFNTEKPVAERSDSKYKGVRKRKWGRWVSEIRLPNSRERIWLGSYDSAEKAAHAFDAALFCLRGNTMKFNFSENPPNIAGGGSLSPSEIQEAAARFANSEPQRGQSGKLEADQSTSVSESRPESPCLSAASDGTVRDMPFFDMAMSTSSSNHPTEYGIFPGFDDLHSGFFAPSFLPNLDHGEGFNLDGVLEEDSFLWNF

SEQ ID NO: 39 - DNA, 648 bp, Arabidopsis thaliana
  AT5G21960.1
atggatgcatccccaaagtacacaggtgtacggaagaggaagtggggaaaatgggtggctgagattcgtctccccaacagccgtgacaggatctggttaggctctttcgactctgctgagaaggcggcgcgtgctttcgacgcggctctttactgtcttcgtggccccggagcacgcttcaacttccccgacaatcctccggagattcccggtggtcgttctctgacgccgcagcagattcaggtcgtagctagccgtttcgcctgcgaggaggagctactaccaccggaacaacatcatccgtcaccgccacgtggcgaccataataccgaggaagaagtgataatttcggcacgtggggaaattaatagtggtagtggtgggcctacgttagggcaagttggggaagataataacaacgagggtaatagtaatgacacgtcgtcgtattggcctttaatatgggaggaggagaattttgtaggtcctcctaactcagatcatgagttcggttttttcacagatgattcaaccaatttgtacttcccgacacaacaacaacaacaacatcagctctcgtctgatttttactatgatggagcttgtgaagatgatttctctcattacaatattaacctttggaatttc

SEQ ID NO: 40 - protein, 216 aa, Arabidopsis thaliana
  AT5G21960.1
MDASPKYTGVRKRKWGKWVAEIRLPNSRDRIWLGSFDSAEKAARAFDAALYCLRGPGARFNFPDNPPEIPGGRSLTPQQIQVVASRFACEEELLPPEQHHPSPPRGDHNTEEEVIISARGEINSGSGGPTLGQVGEDNNNEGNSNDTSSYWPLIWEEENFVGPPNSDHEFGFFTDDSTNLYFPTQQQQQHQLSSDFYYDGACEDDFSHYNINLWNF

SEQ ID NO: 41 - DNA, 633 bp, Oryza sativa
  LOC_Os02g54050.1
atgatgtcatcgtcgtcgccggtggtggcgtcaccgccggagatggagaagaagtacaagggtgtgcggcggcggaagtgggggaagtgggtgtcggagatccggctgcccaatagccgcgaccgcatctggctgggctcctacgactcgccggagaaggcggcgcgggcgttcgacgccgccttcgtcacgctccgcggccacggcgccgccggcgccgacctcaacttcccggactcgccgccgtcgtgcgacgcccgcagcagcgacccgcggcaggtgcaggccgccgcgctctcccacgccaaccgcgcccacgtcacgccgcagcaggcggccgcggcgctcatgtcgccgccctcgctgtcgccgccgccggggttcgccaccggcagcgaggtggtggcgcccgccgtgcgcgccgacggcagcatcgactggcgcccggtcatggcgcacccgccgccgctgtactcgccgcccggctggggcggcggccatgcctacgacttcttgcagccgccgccgccgtcgccgccgttgccgtcgtgcgacgacgacatggtcgacgtcgtagatgagagcagcgcttcgctttggagctttgacacgcgagactcctacttccgatac

SEQ ID NO: 42 - protein, 211 aa, Oryza sativa
  LOC_Os02g54050.1
MMSSSSPVVASPPEMEKKYKGVRRRKWGKWVSEIRLPNSRDRIWLGSYDSPEKAARAFDAAFVTLRGHGAAGADLNFPDSPPSCDARSSDPRQVQAAALSHANRAHVTPQQAAAALMSPPSLSPPPGFATGSEVVAPAVRADGSIDWRPVMAHPPPLYSPPGWGGGHAYDFLQPPPPSPPLPSCDDDMVDVVDESSASLWSFDTRDSYFRY

SEQ ID NO: 43 - DNA, 615 bp, Glycine max
  Glyma15g19910.1
atgagcaaagagcatatcatcactgcaatcgtcatcgtccacgtaggagtacggaagaggaagtgggggaagtacgtgtcggaaattaggctgcccaacagccgtcaaaggatttggttgggttcctacgacagcgccgaaaaggcggcgcgtgcattcgacgcggccatgttctgcttacgtggcagcggtgccaactttaatttcccgagcgaccggcccaacatcgctggcgggaggaacatgacgccctcgcagattcagatcgccgcggcgcgtttcgccaattcggagccccgaaaggagtgttcgggtaaacccgtggagtctttgacttcgattgaggaaacgacgtcgtttccagtaaattcggatacggatacatcttctcctctatcagtagtgacgatccaaaacgacaccgaagtagcaaccgggtcgtttccgggtatattttcgggtttcgggtcgggtaatttcgtccccgaattctccgattttccgagcttcgatgatttcggccacgatttcttcgtgcatgagcttccgggtttcgattacggagaagagaacttggatgggttgataattcaggactcgttcctgtggaatttc

SEQ ID NO: 44 - protein, 205 aa, Glycine max
  Glyma15g19910.1
MSKEHIITAIVIVHVGVRKRKWGKYVSEIRLPNSRQRIWLGSYDSAEKAARAFDAAMFCLRGSGANFNFPSDRPNIAGGRNMTPSQIQIAAARFANSEPRKECSGKPVESLTSIEETTSFPVNSDTDTSSPLSVVTIQNDTEVATGSFPGIFSGFGSGNFVPEFSDFPSFDDFGHDFFVHELPGFDYGEENLDGLIIQDSFLWNF

SEQ ID NO: 45 - DNA, 480 bp, Glycine max
  Glyma17g33530.1
atgttcaaaggggtgaggaagagaaaatggggcaaatgggtgtccgaaattcggcttcccaacagccgcgagcgcatatggttggggtcgtatgacacccaagtgaaggctgccagggcatttgatgccgcgctttattgcctacgtggtcaaagcgcgacattcaatttccctgacacgcctcgacacttggaaaccaacatggtattgtcacgtgacaaacagccgcaacctctatcccaccaagaaattcaagaggtagccgtgaagttcgcgaacaacgacgaccaccctttggaggaggaggagtgggattgggacaccatggattggacatttttgaacatgttggatgacttgaatggctcggattttggcctctatgtggggctagacaagatgcacccgaatgatgaaattgaaggtgatgatgatcatgatgctttttctaaccattccttgctttggagttggaacttt

SEQ ID NO: 46 - protein, 160 aa, Glycine max
  Glyma17g33530.1
MFKGVRKRKWGKWVSEIRLPNSRERIWLGSYDTQVKAARAFDAALYCLRGQSATFNFPDTPRHLETNMVLSRDKQPQPLSHQEIQEVAVKFANNDDHPLEEEEWDWDTMDWTFLNMLDDLNGSDFGLYVGLDKMHPNDEIEGDDDHDAFSNHSLLWSWNF

SEQ ID NO: 47 - DNA, 711 bp, Solanum lycopersicum
  Solyc06g054630.1.1
atggaaaacaattctactcatgatcagccaaagttcaaaggagttcggttgaggaaatgggggaaatgggtttctgaagtcagattgcctaacagccgcgacaggatttggttgggctcctatgattctgccgaaaaagccgcaagggcttttgacgctgcacagttctgcctccgcgggcccaaagccaaatttaactttcctgatagtccgccggatatatccggaggacagaggctttcgcccgcggagatacaggctgtagcagctagatttgcgaatgattactcgccgtcagtggtacaggagatacgccgtgatgatcatcatcatgatcacgagggcaatattggaaatattaattcacacgtgataaatatggagaaagatgagatttcactgtcaacaactagttgtgatagggtggtccaaatgggcactagtaatactgttgctgaaatggattgggcttttcataatgatatgatggaaaactattcatacaatgcaagtgggcctccacctgaatatttttgtgatccatattatatcgtcggaggaggaggaggagcaggagtactcgataatttatcgagtaatctctactcaccaccacattttccgcaaagaacaactcctagttatgacgatgatgatactggcaatggtgacgatgaacattattctcaacaatccttcctatggaacttt

SEQ ID NO: 48 - protein, 237 aa, Solanum lycopersicum
  Solyc06g054630.1.1
MENNSTHDQPKFKGVRLRKWGKWVSEVRLPNSRDRIWLGSYDSAEKAARAFDAAQFCLRGPKAKFNFPDSPPDISGGQRLSPAEIQAVAARFANDYSPSVVQEIRRDDHHHDHEGNIGNINSHVINMEKDEISLSTTSCDRVVQMGTSNTVAEMDWAFHNDMMENYSYNASGPPPEYFCDPYYIVGGGGGAGVLDNLSSNLYSPPHFPQRTTPSYDDDDTGNGDDEHYSQQSFLWNF

SEQ ID NO: 49 - DNA, 621 bp, Oryza sativa
  LOC_Os06g09810.1
atggagccagtgtctttcatgcagaagagcgcggcggcggcggcggacggcggcagcgcggcgcaggcggcggcggagaggaggaaatacaagggcgtgcggctgcgtcagtgggggaagtgggcggcggagatccgtctgcccagcagctgcgagaggatatggctgggatcctacgacacgccggagaaggcggcgcgggcgttcgacgccgcgttcatctgcctccgcggcgtccaagccattgccgggctcaacttccccgagtccccgccgccgcctaccgccgcccgcaccggcgatctgcgtgaggtgtatgccttcgctgtgtcgcatgccaaccggccgtcggccgaagcggcgccggccgacattgttgttccagctcaggtcgcgaccgaggagtccgacggcgtggtgaggggaaatgcggcgccgccgccggtgcaggtggcggctgggagcttggactggtcgcagttcatggcaaacccaccacctatgtactcaccgacggcgacagccggaagccaggcgatgtggccggtgacagcaccggcagcagaagccgacggtgaggatgacgaattagctactacatgtcgttggagcttcgatgcc

SEQ ID NO: 50 - protein, 207 aa, Oryza sativa
  LOC_Os06g09810.1
MEPVSFMQKSAAAAADGGSAAQAAAERRKYKGVRLRQWGKWAAEIRLPSSCERIWLGSYDTPEKAARAFDAAFICLRGVQAIAGLNFPESPPPPTAARTGDLREVYAFAVSHANRPSAEAAPADIVVPAQVATEESDGVVRGNAAPPPVQVAAGSLDWSQFMANPPPMYSPTATAGSQAMWPVTAPAAEADGEDDELATTCRWSFDA

SEQ ID NO: 51 - DNA, 627 bp, Oryza sativa
  LOC_Os06g09790.1
atgcaggccaacacgacgcagccggcgccggagaaggagacgaggtataagggcgtgcggctacggcagtgggggaaatgggtggcggagatccgactgcccaacagccgcaagaggatatggctgggatcctactacacaccggagaaggcggcgcgggcgttcgacgccgcgttcatatgtctccgcggcggtgaggccattgccgggctcaacttcaccgagtcaccgccggccgtcgtcgcccgcaccaccgacccgcgggaggtgctcgccttcgcgacgtcgcatgccaacctgctgtcgttgttggatgccgccattgcgcaagaagaagaagctcattctttcaaaaaagaagaagaagctcaggtggaggagaagacggctgaggagtcctcagacgtggtcagggcaaatgcggcgccaccaccgccggtgcaggtggcaggtgggagctttgactggtcacagctgccgctctactcgccaacgacaaccccagctgcagagcattgggaggaagataacgtcgaaggcgacatacccgtctgtagcgagatatctgtggagacttcgtcaaactcaagatatatcggtgtagtctttcagatgcactcatatggg

SEQ ID NO: 52 - protein, 209 aa, Oryza sativa
  LOC_Os06g09790.1
MQANTTQPAPEKETRYKGVRLRQWGKWVAEIRLPNSRKRIWLGSYYTPEKAARAFDAAFICLRGGEAIAGLNFTESPPAVVARTTDPREVLAFATSHANLLSLLDAAIAQEEEAHSFKKEEEAQVEEKTAEESSDVVRANAAPPPPVQVAGGSFDWSQLPLYSPTTTPAAEHWEEDNVEGDIPVCSEISVETSSNSRYIGVVFQMHSYG

SEQ ID NO: 53 - DNA, 729 bp, Oryza sativa
  LOC_Os08g35240.1
atggatcatattggaattagcggcggcggcgagggcggggtggtgtctccggcgcagccgtcgtcgccggagcggcggtacaagggcgtgcggctgcggaagtgggggcggtgggtgtcggagatccggatgcccaacagccgggagaggatatggctgggctcgtacgagtccgccgagaaggcggcgcgggcgttcgacgccgccgccgtctgcctccgcggctcgcgcggcgccggctcgctcaacttcccggagtccccccctcccgacgtccgccgccgcttccccggcgcggctctcacggtcgagcagatccaggccgaggcggcgaggcacgccaaccgcccgtttccggcgaacaccgccgccgccggcgggtcgtcgtcgtcgtactcgatctcgcagcggcaagaagcagcagcccctgcgcggtcgacgagcaacgacgacacggccatgtcgtcagtgccctccaccgacggcggcgctgccgactacgacggcggtgatgatgtcattgactggtcattcatggacacgttgccggcgatgtcgtcgtcagcggctagtaccaatgctgatctggtcccggccatggatgatttcatgtacgggttcttgcacacaatgccgccatcgccatgcgaagacggtggggaggatgtgatgatcgacggcaattgcaacatggatcagacatttttctcagtagatctttggagattt

SEQ ID NO: 54 - protein, 243 aa, Oryza sativa
  LOC_Os08g35240.1
MDHIGISGGGEGGVVSPAQPSSPERRYKGVRLRKWGRWVSEIRMPNSRERIWLGSYESAEKAARAFDAAAVCLRGSRGAGSLNFPESPPPDVRRRFPGAALTVEQIQAEAARHANRPFPANTAAAGGSSSSYSISQRQEAAAPARSTSNDDTAMSSVPSTDGGAADYDGGDDVIDWSFMDTLPAMSSSAASTNADLVPAMDDFMYGFLHTMPPSPCEDGGEDVMIDGNCNMDQTFFSVDLWRF

SEQ ID NO: 55 - DNA, 669 bp, Oryza sativa
  LOC_Os06g11940.1
atggcgtacatcagtacatcttccacggatcacagcctctcgtgcatgcgtatgcagaccaagaatacggcggcgccggcgccggagaagaagtacaagggcgtgcggctgcggcaatgggggaagtgggtggcggagatccggctgcccaacagccgcgagagggtgtggctgggatcctacgacacgccggagaaggcggcgcgggcattcgacgctgccttcgtcttcctccgcggcgccggagccgccgacgccgcggggctcaacttccccgactcgccgctgccagttgtcgcgcgcactagagatctgcgcgaggtgtatgccttcgcggtctcgcatgccaacaggccgccgccggtggctggagaaacggctgccacggctctggctgcgatggcggcgctggagcacaatgaggtcagggaaaatattgcgccgtcgtcgccgctgtcggcagtgcaggtggcggcgccgccagctgggagctttgattggtcgcagctgatggcgaactcgccgccgctctactcgccaatagtgataggaagccatgcgtacgacgacctggcggtgtggcccacgacgcagccggtggaggaattcagtgaggaggataacgaaaatgaaggtgctacgagtgatgagctttggagcttcgatgtc

SEQ ID NO: 56 - protein, 223 aa, Oryza sativa
  LOC_Os06g11940.1
MAYISTSSTDHSLSCMRMQTKNTAAPAPEKKYKGVRLRQWGKWVAEIRLPNSRERVWLGSYDTPEKAARAFDAAFVFLRGAGAADAAGLNFPDSPLPVVARTRDLREVYAFAVSHANRPPPVAGETAATALAAMAALEHNEVRENIAPSSPLSAVQVAAPPAGSFDWSQLMANSPPLYSPIVIGSHAYDDLAVWPTTQPVEEFSEEDNENEGATSDELWSFDV

SEQ ID NO: 57 - DNA, 642 bp, Brachypodium distachyon
  Bradi3g37544.1
atggatgccgccggtgcgagccgcggcgagggctcggagaggcgctacaagggcgtgcggctccggaaatggggccggtgggtgtcggagatccgcatgcccaacagccgcgagaggatatggctcggctcctacgagtccgccgagaaggccgcgctggcgttcgacgcggccgccgtctgcctccgcggctcccgcgccggctcgctcaacttcccggagtgccctccggacgtccagtacatccccggctcgctgccgacgcctgagcgcatccaggccgtggccgcaaggcacgccaactctgcgtgtccggctccggcggccagggtagtggcggcgagcagtaatgctggggcggcgtcgcaggaagcgccggccacggcacggacgagcacgagcgtggatgctactggatgcgacgacatgcttgattactggtcgttcatggacgagttgccctcgtcgatgccagcgtcgtcgtcgacgtctgcggccaatgccgacatcgttattccggccatggatgatttcatgtacggtttctcgccaccgccgcggcctgcgggagaggcggcggaggatgtgatcgatgaccatggagatgacggtcatacatttttgtctgccctttggaagttc

SEQ ID NO: 58 - protein, 214 aa, Brachypodium distachyon
  Bradi3g37544.1
MDAAGASRGEGSERRYKGVRLRKWGRWVSEIRMPNSRERIWLGSYESAEKAALAFDAAAVCLRGSRAGSLNFPECPPDVQYIPGSLPTPERIQAVAARHANSACPAPAARVVAASSNAGAASQEAPATARTSTSVDATGCDDMLDYWSFMDELPSSMPASSSTSAANADIVIPAMDDFMYGFSPPPRPAGEAAEDVIDDHGDDGHTFLSALWKF

SEQ ID NO: 59 - DNA, 690 bp, Zea mays
  GRMZM2G163745_T01
atggacgatggcgccggagcaagccgcagcgacgacggcgaggtatctccgcggctgccggcggagcggcgttacaagggcgtgcgcctgcggaaatggggccggtgggtgtcggagatccggatgcccaacagccgcgagagggtctggttgggctcatacgagtcagcggagaaggcggcgcgggcgttcgacgccgctgccgtctgcctccgcggctcccgggccgggtcgctcaacttccccgagtctccgcccaacgtccggtacgtccctggcgcgctgctgacgcctgagcagattcaggcagaagctgcaaggcacgctaaccagcagctgcctagtcggccggtcgcgtcggcgttgcagccagcagctgcaccacccgcgggaggaccaagcagtgacaggacgaccttgtccatgccgtccactgactacagtagtggagctgccgtctgcggtgacgacgaggcgcttgattggtctttcatggatgctttgccacctatgccgccggcgtcttcatcagtggggatggggaacagtgctcatactgtaccggcggccatggatgatttcatgtacgggtcccctcacctggttgtacagccgagtgaagatgccacacaggatgtaattgacagcgatgatgaccatacattcatctcagacgacctctggcgattc

SEQ ID NO: 60 - protein, 230 aa, Zea mays
  GRMZM2G163745_T01
MDDGAGASRSDDGEVSPRLPAERRYKGVRLRKWGRWVSEIRMPNSRERVWLGSYESAEKAARAFDAAAVCLRGSRAGSLNFPESPPNVRYVPGALLTPEQIQAEAARHANQQLPSRPVASALQPAAAPPAGGPSSDRTTLSMPSTDYSSGAAVCGDDEALDWSFMDALPPMPPASSSVGMGNSAHTVPAAMDDFMYGSPHLVVQPSEDATQDVIDSDDDHTFISDDLWRF

SEQ ID NO: 61 - DNA, 792 bp, Arabidopsis thaliana
  AT1G59640.1
atggatccgagtgggatgatgaacgaaggaggaccgtttaatctagcggagatctggcagtttccgttgaacggagtttcaaccgccggagattcttctagaagaagcttcgttggaccgaatcagttcggtgatgctgatctaaccacagctgctaacggtgatccagcgcgtatgagtcacgcgttgtctcaggcggttattgaaggtatctccggcgcttggaaacggagggaagatgagtctaagtcggcgaagatcgtctccaccattggcgctagtgaaggtgagaacaaaagacagaagatagatgaagtgtgtgatgggaaagcagaagcagaatcgctaggaacagagacggaacaaaagaagcaacagatggaaccaacgaaagattatattcatgttcgagctagaagaggtcaagctactgatagtcacagtttagctgaaagagcgagaagagagaaaataagtgagcggatgaaaatcttgcaagatcttgttccgggatgtaacaaggttattggaaaagcacttgttctagatgagataattaactatatacaatcattgcaacgtcaagttgagttcttatcgatgaagcttgaagcagtcaactcaagaatgaaccctggtatcgaggtttttccacccaaagagtttggtcagcaagcgtttgagaatccggagatacagttcgggtcgcagtctacgagggaatacagtagaggagcatcaccagagtggttgcacatgcagataggatcaggtggtttcgaaagaacgtct

SEQ ID NO: 62 - protein, 264 aa, Arabidopsis thaliana
  AT1G59640.1
MDPSGMMNEGGPFNLAEIWQFPLNGVSTAGDSSRRSFVGPNQFGDADLTTAANGDPARMSHALSQAVIEGISGAWKRREDESKSAKIVSTIGASEGENKRQKIDEVCDGKAEAESLGTETEQKKQQMEPTKDYIHVRARRGQATDSHSLAERARREKISERMKILQDLVPGCNKVIGKALVLDEIINYIQSLQRQVEFLSMKLEAVNSRMNPGIEVFPPKEFGQQAFENPEIQFGSQSTREYSRGASPEWLHMQIGSGGFERTS

SEQ ID NO: 63 - DNA, 729 bp, Glycine max
  Glyma04g34660.1
atggatcctcctctcatcagcgactccacattctcccccgcttactccctcgccgagatttggcctggaatgccccattttcccgatcactctcacctcaccgccaccgctcccaccaagggaaaggactccaccgccgccgacgaggtcctctcctccaccaccactgccaacctatccaataatgattctggtagcaacaaacggatgaaggtaggagggtccagttttgaaaacgatggtttcaaagcggaggcagaagcaagttctgtgggtggtaacaagtcaagtgagcaaagcaataaaccttgtgaggcacctaagccagactatattcatgtgagagcaagaaggggccaagctaccgatagccacagtctagcagagagagcaagaagagaaaagatcagtgagaggatgaaaattcttcaggatttggtgccagggtgtaacaaggtaatcggtaaagcacttgtcctagatgagataatcaactacatccagtcgctgcagcgtcaagttgagttcctttcaatgaagcttgaagcagttaattcaagaatgaacacgaaccctactattgatgggtttccttcaaaagatgttggtactcagccatttgacattgctggaatggtatttggatcacaagcagcaagggggtatgctcagggatcatcacatcctgggtggctgcatatgcagataggtggtgggtttgagacaaca

SEQ ID NO: 64 - protein, 243 aa, Glycine max
  Glyma04g34660.1
MDPPLISDSTFSPAYSLAEIWPGMPHFPDHSHLTATAPTKGKDSTAADEVLSSTTTANLSNNDSGSNKRMKVGGSSFENDGFKAEAEASSVGGNKSSEQSNKPCEAPKPDYIHVRARRGQATDSHSLAERARREKISERMKILQDLVPGCNKVIGKALVLDEIINYIQSLQRQVEFLSMKLEAVNSRMNTNPTIDGFPSKDVGTQPFDIAGMVFGSQAARGYAQGSSHPGWLHMQIGGGFETT

SEQ ID NO: 65 - DNA, 807 bp, Glycine max
  Glyma06g20000.1
atggatcctcctctcatcactgactccacattctcccccgcttactctctcgccgagatttggcccggaatgccccatttcccccctcccttcccccacccctcctccgccgatcactccaccctcaccgacctcaccgccaccccccgcaagagaaaggactgctcctcctcctcctcctccgcctccgccgccgacgaggacgactgctccaaggtcctctcctccaccaccaccgccactgccaacctctccaataatgattctggtagcaataaacagatgaagttaggagggtccagtgttgaaaacgatggtttcaaagctgaggcagaagcgagttctgcgggtggtaacaagtcaagtgagcaaagcaataaaccttgtgaggcacctaagcaagactatattcatgtgagagcaagaaggggccaagcaaccgatagccacagtctggcagagagagcaagaagagaaaagatcagtgagaggatgaaaattcttcaggatttggtgccagggtgtaacaaggtaattggtaaagcacttgttctagatgagataatcaattacatccagtcactgcagcgtcaggttgagttcctttcaatgaagcttgaagcagttaattcaagaatgaacatgaaccctactattgatgggtttccttcaaaagatgttggtactcagccatttgacattgctggaatggtatttggatcacaggcagcaagggggtatgctcagggatcatcacctcctggatggctgcatatgcagataggaggtggtttcgagagaacaaca

SEQ ID NO: 66 - protein, 269 aa, Glycine max
  Glyma06g20000.1
MDPPLITDSTFSPAYSLAEIWPGMPHFPPPFPHPSSADHSTLTDLTATPRKRKDCSSSSSSASAADEDDCSKVLSSTTTATANLSNNDSGSNKQMKLGGSSVENDGFKAEAEASSAGGNKSSEQSNKPCEAPKQDYIHVRARRGQATDSHSLAERARREKISERMKILQDLVPGCNKVIGKALVLDEIINYIQSLQRQVEFLSMKLEAVNSRMNMNPTIDGFPSKDVGTQPFDIAGMVFGSQAARGYAQGSSPPGWLHMQIGGGFERTT

SEQ ID NO: 67 - DNA, 723 bp, Populus trichocarpa
  POPTR_0010s04920.1
atggatccgcctgcaaggatgaatgaaggagggccttacagtttggaggagatctggcaatttcccattaacgggagcggaagagggcactttgatttacttaatttggagcagagagcagctgcttctgtcaggaaacgtcgcgatgttgatttggatgttgatgatgattcttcttcaaaacccactaccaacggacttctgcggcttaaaacatcagggagtaaagatgaggatcaccatcgtcatcatgattctaaagatgaagcagaacccagttcaggcaagcatgtggaacacaaaactcaaccaccagagccatcaaaacaagattatatccacgtacgagcaagaaggggtcaagctactgatagccacagtctagctgaaagagctaggagagaaaagataagcgaaaggatgaaaattcttcaggatctagtcccaggctgtaacaaggttattggcaaggccctggtccttgacgagattatcaattacatccaatcattacaacgtcaggttgagtttctatcaatgaagcttgaagcagtgaatacgagaatgaaccctggaattgaagtctttgcttctaaagattttggacaaacttttgacactgctggcatggcatttggttctcaagccacgagggaatacagtcgtggtacatcaccagaatggttgcatatgcaggttggtggtggtttcgaaagaacgtca

SEQ ID NO: 68 - protein, 241 aa, Populus trichocarpa
  POPTR_0010s04920.1
MDPPARMNEGGPYSLEEIWQFPINGSGRGHFDLLNLEQRAAASVRKRRDVDLDVDDDSSSKPTTNGLLRLKTSGSKDEDHHRHHDSKDEAEPSSGKHVEHKTQPPEPSKQDYIHVRARRGQATDSHSLAERARREKISERMKILQDLVPGCNKVIGKALVLDEIINYIQSLQRQVEFLSMKLEAVNTRMNPGIEVFASKDFGQTFDTAGMAFGSQATREYSRGTSPEWLHMQVGGGFERTS

SEQ ID NO: 69 - DNA, 792 bp, Glycine max
  Glyma01g04610.1
atggatccggcggcgatgatgaacggcggcgccaacccgacgtcgtatcacctgtcagagatctggcagttcccgcctcccaacgcgccagacgagctgggactcagaaggccccacttcacccacggcttcgcggacttcgccccggatccgacccgagacgccgtcccgggtcgcgacccggccagcattgcccagaagaagcgccgcgacgcctcggccgaggaggaggaatccgctaagggcgcctccaccaccaatgccgtgaatgaggggggtggtgttggtgatgggaaacgggtcaagacgagtgagagtgggaaaggtgaaggagaaaccagttcaggaaagcttgcggagcaaagtggtaagccaccttcggagcctccaaagcaagactacattcatgtccgagccagaaggggtcaagctactgatagccacagtcttgcagaaagagctagacgcgaaaagatcagtgagaggatgaaaattcttcaggatatagtcccgggttgtaataaggttattgggaaagcattggtccttgatgagataattaattatatccaatcgcttcagcggcaagtagagtttttgtcaatgaagcttgaagcagtaaattcaagactggcccccagaattgaagtgtttcctcctaaagattttgatcagcaaacatttgatacaactggcatgccgtttgcttcccaagctacaagagagtatagccgaggttcatcgccagaatggttacatatgcaggttggaggtggttatgaaagagcaacg

SEQ ID NO: 70 - protein, 264 aa, Glycine max
  Glyma01g04610.1
MDPAAMMNGGANPTSYHLSEIWQFPPPNAPDELGLRRPHFTHGFADFAPDPTRDAVPGRDPASIAQKKRRDASAEEEESAKGASTTNAVNEGGGVGDGKRVKTSESGKGEGETSSGKLAEQSGKPPSEPPKQDYIHVRARRGQATDSHSLAERARREKISERMKILQDIVPGCNKVIGKALVLDEIINYIQSLQRQVEFLSMKLEAVNSRLAPRIEVFPPKDFDQQTFDTTGMPFASQATREYSRGSSPEWLHMQVGGGYERAT

SEQ ID NO: 71 - DNA, 768 bp, Oryza sativa
  LOC_Os07g09590.1
atggacccggccccctcgctcgcggcggagctctggcggccgcatcaccaccgccaccacttcgaggcgtcgtccgtcgtcaccgaccaggggagcggaagccgcggcggaggaggaagcgggcgcaggaggccgcggagcgacgcggggcccgaggacgacgacttgtccaaggtcgtctccacctccgccgcctccggcggcggcggcggcggcgggcaggactcggatgctccagaagcaaaacgtttgaaaccaatgaaatctagtgataagaatgatagtttaaggacagaagctggaaccgattcaggaaacagcagtaaggctgctgataaaaatgctacaccaccagagccaccaaaacaagactacattcatgtgagggcaagaagaggtcaagcaaccgatagccatagccttgcggagcgggcacggcgagagaagataagtgaacggatgaaaattcttcaagatcttgtccctggatgcaataaggtcattgggaaagcatcagtccttgatgaaataataaattacatccagtctttacagcatcaagttgagtttttgtccatgaagcttgaagcagttaatagtcacatgattaacggaattgttgcttttccatctaaagattttggtgctcagccatataacacagctgctggtttgacatttgatccacaaacaacaagggaatttgcccagggttcaacatcagagtggcttcacatgcagattggaaatgcatatgaaagagtgaca

SEQ ID NO: 72 - protein, 256 aa, Oryza sativa
  LOC_Os07g09590.1
MDPAPSLAAELWRPHHHRHHFEASSVVTDQGSGSRGGGGSGRRRPRSDAGPEDDDLSKVVSTSAASGGGGGGGQDSDAPEAKRLKPMKSSDKNDSLRTEAGTDSGNSSKAADKNATPPEPPKQDYIHVRARRGQATDSHSLAERARREKISERMKILQDLVPGCNKVIGKASVLDEIINYIQSLQHQVEFLSMKLEAVNSHMINGIVAFPSKDFGAQPYNTAAGLTFDPQTTREFAQGSTSEWLHMQIGNAYERVT

SEQ ID NO: 73 - DNA, 813 bp, Setaria italica
  Si030790m
atggatcccgcagcctcgtctgtggtagccgccgagctctggcggccgccgcaccaccaccacctcgcccccgccgcctccggcccgcaccacgaggcctcctccgtcgtcaccaccgccgaccggagcaacggcggacgctccggcggcgggtccagccgcaggaggccgcgacgcgacgcgcctgcagctgaggaggagccgtccaagctcgcctccacctccggcaccgccgccgccagcggcggcggcggcggtggccgggactcggctgacccagaaatggcaaaacgtttgaagaagatgacatctagtgatgataaaataaggacagaagttgaaacaaattcaggcaatgctagcaagtctgttgataaaaaacctgcaccaccagagccaccaaaacaagactacatccatgtgagggctagaagaggtcaagcaacggacagccatagccttgcagaaagagcacgacgagagaagataagtgaacggatgaaagttcttcaagatcttgtccctggatgcaataaggttattgggaaagcatcagtccttgatgagataataaattacatccaatctctacagcgtcaagtggagtttttgtccatgaagcttgaagcggttaatgcccatgtgaacagtgcaactgggtctttcccatctaaagattttgatgctccagctccgccttatagtacggcacctggtctgacattcgatccacacacaccaagggaataccctcaggccttgacatcagactggcttcacatgcagattggcaatacatatgaaagagtgaca

SEQ ID NO: 74 - protein, 271 aa, Setaria italica
  Si030790m
MDPAASSVVAAELWRPPHHHHLAPAASGPHHEASSVVTTADRSNGGRSGGGSSRRRPRRDAPAAEEEPSKLASTSGTAAASGGGGGGRDSADPEMAKRLKKMTSSDDKIRTEVETNSGNASKSVDKKPAPPEPPKQDYIHVRARRGQATDSHSLAERARREKISERMKVLQDLVPGCNKVIGKASVLDEIINYIQSLQRQVEFLSMKLEAVNAHVNSATGSFPSKDFDAPAPPYSTAPGLTFDPHTPREYPQALTSDWLHMQIGNTYERVT

SEQ ID NO: 75 - DNA, 681 bp, Solanum lycopersicum
  Solyc04g005130.2.1
atggatcctcattctactataatgagtgcgtttcaaactgcgactaatttggcggagatctggccctatcaccatcttctcgaccacactactaatcacgccgccacaaagcgacgcgacgatgatgaatctgctattgcagtttcaactagtggaaatgccttgactgaatctgatagtaagcggctgaaggccacaagatcaaacgagaatggggaatattcaggagggaattcaggaaaatcttcagaccaacctgcaaagccaccagctgaaccacctaaggactacatccatgtgcgagcgaggagaggtcaagctaccgatagtcatagcctagcagaaagagccagaagagaaaagattagtgacaggatgaaaatcctacaagacttggtccctggttgtaacaaggttattggaaaagctcttgtccttgatgagataatcaattatgtccaatcattacaacgtcaggttgagttcctatcaatgaagcttgaagcagttaatacaagagtaaccccaaccatcgaaggaattcctactaaagactttgggcagcaaacattcgagacaaacgctatggcatttggttcacaaggtacaagggaatatgctggggggacatcaccagactggttgcacatgcagataggtggtggatttgaaagaacgaca

SEQ ID NO: 76 - protein, 227 aa, Solanum lycopersicum
  Solyc04g005130.2.1
MDPHSTIMSAFQTATNLAEIWPYHHLLDHTTNHAATKRRDDDESAIAVSTSGNALTESDSKRLKATRSNENGEYSGGNSGKSSDQPAKPPAEPPKDYIHVRARRGQATDSHSLAERARREKISDRMKILQDLVPGCNKVIGKALVLDEIINYVQSLQRQVEFLSMKLEAVNTRVTPTIEGIPTKDFGQQTFETNAMAFGSQGTREYAGGTSPDWLHMQIGGGFERTT

SEQ ID NO: 77 - DNA, 687 bp, Glycine max
  Glyma17g10290.1
atggaacctcctctcatcaacgactccacattctcttccgctaacccttccttgtccgagatttggccctctcattttcccacagaccacactcccagtaacaagagacacctctccccctcgactgattgtggcagcaataaacatatcaaatcatcaggatcaggatcccaggatcaaaacggtgccttgaaggcgggtgaagtggacgcgacttcagtagccggtaacaagttacccgaacaaacggcgaaacctagttcttccgagcagccacctaagcaagactatatacacgtgcgagctagaagaggccaagccaccgatagccacagtctcgctgagagagctaggagagaaaagatcagtgagaggatgaaaattcttcaagatatagttcccggctgcaacaaggtaattggtaaagcacttgtgctggatgagataattaattatatccagtcactgcagcatcaggttgagttcctttctatgaagcttgaggcagttaattcgagattgagcatgagccctactattgaatgttttccttcaaaagaagttggcactcagccatttgaccttgccggaataatatttggatcacaaccggccaggggatatgctcaaggatcacagccgggatggctgcatatgcagatagctggtggttttgagaaagcaaca

SEQ ID NO: 78 - protein, 229 aa, Glycine max
  Glyma17g10290.1
MEPPLINDSTFSSANPSLSEIWPSHFPTDHTPSNKRHLSPSTDCGSNKHIKSSGSGSQDQNGALKAGEVDATSVAGNKLPEQTAKPSSSEQPPKQDYIHVRARRGQATDSHSLAERARREKISERMKILQDIVPGCNKVIGKALVLDEIINYIQSLQHQVEFLSMKLEAVNSRLSMSPTIECFPSKEVGTQPFDLAGIIFGSQPARGYAQGSQPGWLHMQIAGGFEKAT

SEQ ID NO: 79 - DNA, 804 bp, Populus trichocarpa
  POPTR_0008s19510.1
atgatcaggatggatccgcctgcaatgatgaacgaagggggcccctacactttagaggagatctggcaatttcccatcaatggtagcggaagagggcagtttgaattacttaatttggagcggagagcagcagcttctgccaggaaacgccgcgaggttgatttggatgttgatgattcttcttcttcaaagcctacaactctctctcctaccaatgccaataccaacaccaacggacttctgaatgattgtgatggtaagcggcttaaagcatgggggagtagagatgacaatcatcatcatcaacaacaacaacaacagcagcagcatgattctagaagtgaagcagaacccagttcaggcaagcttgtggaacacaaacctcaaccaccagaaccgcccaaacaagattatatccacgtacgagcaagaaggggtcaagctactgatagccatagtctagctgaaagagctaggagagaaaagataagcgaaaggatgaaaattcttcaggatatcgtcccaggttgtaacaaggttaccggcaaggccctggtccttgacgagattatcaattacatccaatcattacaacgtcaggttgagtttctatcaatgaagcttgaagcagttaatttgaatatgaaccctgaaactgaagtctttccttctaaagattttggccaacatacttttgatactgctggcatggcatttggttcacaagccacgagggaatacaatcactgtacatcaccggaatggttgcatatgcaggttggtggtggttttcaaagaacgtca

SEQ ID NO: 80 - protein, 268 aa, Populus trichocarpa
  POPTR_0008s19510.1
MIRMDPPAMMNEGGPYTLEEIWQFPINGSGRGQFELLNLERRAAASARKRREVDLDVDDSSSSKPTTLSPTNANTNTNGLLNDCDGKRLKAWGSRDDNHHHQQQQQQQQHDSRSEAEPSSGKLVEHKPQPPEPPKQDYIHVRARRGQATDSHSLAERARREKISERMKILQDIVPGCNKVTGKALVLDEIINYIQSLQRQVEFLSMKLEAVNLNMNPETEVFPSKDFGQHTFDTAGMAFGSQATREYNHCTSPEWLHMQVGGGFQRTS

SEQ ID NO: 81 - DNA, 831 bp, Eucalyptus grandis
  Eucgr.K02908.1
atggatcctccaattgtcaatgaatcttcgttctccgctgcgaacccatcttcctacagtttggatgagatttggccgttcaatggggagccgggtaatggcgggttggggctccgaatggggaatttgagcgggttcttggatggtcagatgaaccgggacgggtcggcggaggtgtccaccgtgacggagcaaagcggtggtggaggaattgggaggaagaggaaggatgtgagttcggaggacgagtcctccaaaatggtgtccactagtagtgccgatgatctgaacatgtcaaatggaaagcgcataaagtcactggtttcaaggcatgacaatggtggatcaagagctgaaggagaatcaagttctgctgctggtgataagcaggctggacagattgcaaagccctctgaaccaccaaagaaggattatattcatgtcagagcacgaagaggccaagctacagatagtcatagcctagctgagagagcaaggagagaaaagatcagtgagcggatgaagattcttcaagacttagtccctggatgcaacaaggttattggaaaagcactcatccttgatgagattatcaactacattcagtcactgcagaatcaggtcgagttcttatcaatgaagcttgaagcagtcaattcaaggatgaacatcaatcctactattgatggatttccagcaaaagatcttggtgggcagccatttgatgcaactggggtgatgcatgcttcgcaagcagcaagacagtacagtcaaggatcgcaatcagaatggttgcatatgcagttaggtgggggtttcgagaggccgatg

SEQ ID NO: 82 - protein, 277 aa, Eucalyptus grandis
  Eucgr.K02908.1
MDPPIVNESSFSAANPSSYSLDEIWPFNGEPGNGGLGLRMGNLSGFLDGQMNRDGSAEVSTVTEQSGGGGIGRKRKDVSSEDESSKMVSTSSADDLNMSNGKRIKSLVSRHDNGGSRAEGESSSAAGDKQAGQIAKPSEPPKKDYIHVRARRGQATDSHSLAERARREKISERMKILQDLVPGCNKVIGKALILDEIINYIQSLQNQVEFLSMKLEAVNSRMNINPTIDGFPAKDLGGQPFDATGVMHASQAARQYSQGSQSEWLHMQLGGGFERPM

SEQ ID NO: 83 - DNA, 795 bp, Oryza sativa
  LOC_Os03g58830.1
atggaccccgcccccacgctcgccgccgagctctggcgaacgccgtacctcggtggcggtggtggtggaggaggaggagggcgtgggttggaggcggcggcgtccggggtcacggagcagagcaatgggagccgcgggggtggcggaggaggaggcgcagggcggaggaggcagcgggaggcccccgcgctcgaggacgactcgtccaggatcgtctccacttccggaggaggaggcggcggtcaggatttgactgattcagaagcaaagcgtttcaaggcaagtaaatcaagtggagataatagcagtttaagaacagaggctgaaactgattcaagaaatgctagcaagtctggtgatcaaaatccgccaccaccagaaccaccaaagcaagactacatccatgtgagggcaagaaggggtcaagctactgacagccatagccttgccgaaagggcacgtcgtgagaaaataagtgagcggatgaaaattctccaggatcttgtccctggatgcaacaaggttattgggaaagcatcagtacttgatgagataattaattatatccaggctttgcaacggcaagttgagtttttgtccatgaagcttgaggctgttaatgctcatgtgaataatggaatcgaagcatttccacccaaagattttggtgctcaggtatacaacacggctcctggattgacgtttgatccacaaacaccaagagaatacgcccagggatcaacaccatcggaatggctccacatgcagattggtggcacctatgaaagagtgaca

SEQ ID NO: 84 - protein, 265 aa, Oryza sativa
  LOC_Os03g58830.1
MDPAPTLAAELWRTPYLGGGGGGGGGGRGLEAAASGVTEQSNGSRGGGGGGGAGRRRQREAPALEDDSSRIVSTSGGGGGGQDLTDSEAKRFKASKSSGDNSSLRTEAETDSRNASKSGDQNPPPPEPPKQDYIHVRARRGQATDSHSLAERARREKISERMKILQDLVPGCNKVIGKASVLDEIINYIQALQRQVEFLSMKLEAVNAHVNNGIEAFPPKDFGAQVYNTAPGLTFDPQTPREYAQGSTPSEWLHMQIGGTYERVT

SEQ ID NO: 85 - DNA, 765 bp, Setaria italica
  Si037131m
atggacccggccccggcggtcgctgcggagctctggcgcccgcctcacctcgccgcgggcggcggccgggcggtggaagccacctccgccgtcacggagaagagcggcggcggccggggaggaggcagcgccggacggagaaagcagcgggaggcaccggcgtccgaggacgactcgtcccggatcgtctccacttccggcggcggcggcggtcaggatttgacagattcaggagcaaaacgtttcaaaacaaataaatccaacgataataatggcaaccaaagaacagaggctgaaactcaaacaagaagcgctggcaagggtgttagtaaaaaccctccagcgccagagccaccgaaacaagattacatccatgtcagggcaagaaggggccaagcaactgacagtcatagtcttgcagaaagggcacggcgtgagaaaataagcgaacggatgaaagttctccaggatctcgtccctggatgcaacaaggttattgggaaagcatcagtacttgacgagataattaattacattcagtctttgcaatgccaagttgagttcctgtcaatgaaacttgaggcggtaaatgcccatgcgaacaatggtgaagcatttccatccaaagattttgctgcgcagacatacaacacagctcctggactgacatttgatacccaaaccccaagagaatacgctcaaggcacatcggcctcggaatggcttcacatgcagattggcggtggtgcctacgaacgggtgtca

SEQ ID NO: 86 - protein, 255 aa, Setaria italica
  Si037131m
MDPAPAVAAELWRPPHLAAGGGRAVEATSAVTEKSGGGRGGGSAGRRKQREAPASEDDSSRIVSTSGGGGGQDLTDSGAKRFKTNKSNDNNGNQRTEAETQTRSAGKGVSKNPPAPEPPKQDYIHVRARRGQATDSHSLAERARREKISERMKVLQDLVPGCNKVIGKASVLDEIINYIQSLQCQVEFLSMKLEAVNAHANNGEAFPSKDFAAQTYNTAPGLTFDTQTPREYAQGTSASEWLHMQIGGGAYERVS

SEQ ID NO: 87 - DNA, 672 bp, Glycine max
  Glyma05g01590.1
atggaacctcttctcttcaacgactccacattctcttcagctaacccttctttgtctgagatttggccctctcatttcccctccgatcacactcccaggaagaggcgcctctccccctcgagtgattctgccagcaataaacatatcaagttatcagcaccagaatcccaggatcaaaacggtgcgttgaaggttggtgaagtagacgcgacttccgtggccggtaacaagctacctcaacaaaccccgaaacctagttcttcggagcaggcacctaagcaagactatatacacgtgcgagccagaagaggccaagccaccgataaccacagtctggctgagagagctagaagggaaaaaatcagtgagaggatgaaaattcttcaggatttagtccccgggtgcaacaaggtaattggtaaagcatttgtgctggatgagataattaattatgtccagtcactgcaacgtcaggttgagttcctttcaatgaagcttgaggcagttagttcgagattgagcatgaagcctactcttgaatgttttccttcaaaagaagtttgcactcaggccggaataatatttggatcacaaccggccaagggatatgctcaaggatcacaaatgggatggctgcatatgcagatagctggtggttttgagaaagcaaca

SEQ ID NO: 88 - protein, 224 aa, Glycine max
  Glyma05g01590.1
MEPLLFNDSTFSSANPSLSEIWPSHFPSDHTPRKRRLSPSSDSASNKHIKLSAPESQDQNGALKVGEVDATSVAGNKLPQQTPKPSSSEQAPKQDYIHVRARRGQATDNHSLAERARREKISERMKILQDLVPGCNKVIGKAFVLDEIINYVQSLQRQVEFLSMKLEAVSSRLSMKPTLECFPSKEVCTQAGIIFGSQPAKGYAQGSQMGWLHMQIAGGFEKAT

SEQ ID NO: 89 - DNA, 816 bp, Solanum lycopersicum
  Solyc05g006650.2.1
atggatccacaagcttccatgatgaaccacgccggaggatttcagtctccgccgtttaatttatctgagatctggcagtttccgatcaatgcaggtgaaggtgagacgccgtatagttttccgttgtctacggcggctgcgccgcagaatgtgagtgatgatgttcggaataatgatcctatggttctagaccggagaactaataattacagcggtggcggcggtggtggtgcagctaggaagcgaaacgaggatgatgaatcagctaaaggagtttccactagcggcaatggcttgactgaatctgctagtaagcggatgaaggttacaagatcaaatgagaattgcgaagctagaggtgacggggaagggaattcagtgaaatctgcagaacaacctgcaaagcctgctgaaccgccaaaagattacattcacgtgcgggcaaggaggggtcaagctactgatagtcacagtctagcagaaagagctaggagagagaagataagtgagaggatgaaagtcctccaagatatagtccctggttgtaataaggttattggcaaagctcttgttcttgatgagataataaattatattcaatcattacaacaccaggttgagttcttatcaatgaagcttgaagcagttaattcaaaaatgccaagcatagagggatatccatctaaagatttcggacagcagccatttgatacaaatgctatggcattcagttcacaagctacaagggaatataccaggggaacatcaccagattggttgcatatgcagcttggtggaggctttgaaagaacaaca

SEQ ID NO: 90 - protein, 272 aa, Solanum lycopersicum
  Solyc05g006650.2.1
MDPQASMMNHAGGFQSPPFNLSEIWQFPINAGEGETPYSFPLSTAAAPQNVSDDVRNNDPMVLDRRTNNYSGGGGGGAARKRNEDDESAKGVSTSGNGLTESASKRMKVTRSNENCEARGDGEGNSVKSAEQPAKPAEPPKDYIHVRARRGQATDSHSLAERARREKISERMKVLQDIVPGCNKVIGKALVLDEIINYIQSLQHQVEFLSMKLEAVNSKMPSIEGYPSKDFGQQPFDTNAMAFSSQATREYTRGTSPDWLHMQLGGGFERTT

SEQ ID NO: 91 - DNA, 831 bp, Eucalyptus grandis
  Eucgr.B03392.1
atggatccgcccgcggcgatgatcaacggcgggggctcgttccccggcggcgacccggtgccgtacaacctggcggacatgtggctgccgccggccggcggagggctggggctcgggaggcatccgggggcgcggggcatcgcccagttcctgaatggcagcggcccgaatctcgaggcctccggcggtgatccggcggtgagtgcggcggaggccagatgcggcggcggttctagaaagcggcgggacgcggaggacgaatcggcggctgggagcctctccaccagcaatggcgtgccgaacggcgctgatggcgagaaacggcttaaaacttccggatgcaaagacaggagtggagattccaaagcagaaggacagcccagctcggccaaacccacggacgaaagtaagccgcagccagagccttccaagcaagactacatccacgtgcgagcccgaagaggccaagccacggatagccacagcttagccgaaagagccagaagagaaaagataagtgagagaatgaaaattcttcaggatatagtgcctggatgtaacaaggtaattggcagagcgctggttcttgatgagattatcaattacatccaatcgctacaacatcaggtcgagttcctgtcaatgaaactcgaggcggttaattcaagaatgaacccaccaatcgaagtattttcttctaaagaatttggtcaacagccgtatgatactggcggcatgcctttcggttcacaagctcccagagaatatagccgtggttcttcgccagactggttacatatgcaggttggtggtggcttcgacaggaaaatt

SEQ ID NO: 92 - protein, 277 aa, Eucalyptus grandis
  Eucgr.B03392.1
MDPPAAMINGGGSFPGGDPVPYNLADMWLPPAGGGLGLGRHPGARGIAQFLNGSGPNLEASGGDPAVSAAEARCGGGSRKRRDAEDESAAGSLSTSNGVPNGADGEKRLKTSGCKDRSGDSKAEGQPSSAKPTDESKPQPEPSKQDYIHVRARRGQATDSHSLAERARREKISERMKILQDIVPGCNKVIGRALVLDEIINYIQSLQHQVEFLSMKLEAVNSRMNPPIEVFSSKEFGQQPYDTGGMPFGSQAPREYSRGSSPDWLHMQVGGGFDRKI

SEQ ID NO: 93 - DNA, 765 bp, Zea mays
  GRMZM2G137358_T01
atggagccgtccccggcggtcgctgcggagctctggtgctcaccgcacctcgccgcgggcggcggccgcccgttggaggcgacctcggccgtcacggagaagagcagcggcggccgcggaggaggcggcgccgtccggaggaggccgagggagaccccggtgtccgaggatgactcgtcccggatcgtctccacttccggcggtggcggcggccaggatttgactgatctagaagcaaagcgttccaaaacaaataagtccagtaataataaaggcagtctaagaacagaggttgaaactgactcaagaagtgctggcaaggctgttagtaaaaacattccagcagcagagccaccaaaacaagattatatccatgtcagggcaaggaggggtcaagcaactgatagtcatagtcttgcagagagggcacgtcgtgagaaaataagtgaacgaatgaaagttctccaagatcttgtgcctggatgcaacaaggttattggcaaagcatcagtacttgatgagataattaattacatccagtcgttgcaatgtcaagttgagttcctgtccatgaaactagaggcagtgaatgcccaggcaaaccagggagttgaagtatttccagccaaagattacggttctcagacatacaacacagctcctgggctgacatttgatacgcaaaccagtagagaatacgcccagggcacgtcgacctcggaatggcttcacatgcagattggcagtggctatgaaagggtttca

SEQ ID NO: 94 - protein, 255 aa, Zea mays
  GRMZM2G137358_T01
MEPSPAVAAELWCSPHLAAGGGRPLEATSAVTEKSSGGRGGGGAVRRRPRETPVSEDDSSRIVSTSGGGGGQDLTDLEAKRSKTNKSSNNKGSLRTEVETDSRSAGKAVSKNIPAAEPPKQDYIHVRARRGQATDSHSLAERARREKISERMKVLQDLVPGCNKVIGKASVLDEIINYIQSLQCQVEFLSMKLEAVNAQANQGVEVFPAKDYGSQTYNTAPGLTFDTQTSREYAQGTSTSEWLHMQIGSGYERVS

SEQ ID NO: 95 - DNA, 819 bp, Eucalyptus grandis
  Eucgr.B00385.1
atggacgcgccgctggtcaacgcgtcctccttctccgccgccaacccctccgcctacagcttggccgagatttggcccctcggcggggacaccggcattgtcgggccgggcctccgggccgggaacctcgacgggtcggtggaggagtccacggtgacggagcagagcggcagcgggaggaggaggaggaggatgaaggacgcgagctccgaggacgagtcgtccaagatggtgtcctcgagctgcgtcgtgggcagtgatttgaacaattcgaatggtgccaaacgcgcgaagatagccggatcccgtgatgaaaatggcagttccaaagctgaagtagaggcgaattctgttgcttgtaataaatcgtcggcagaacagagtgctaaaccgtctgagccaccaaagcaagactacatacatgtgagggcgaggaggggccaagcgacggacagtcatagcttagcagaaagagctaggagagagaagattagtgagaggatgaaaactcttcaagatttggtccctggttgcaataagatcattggaaaggcactggttcttgatgagattatcaattatatccaatcattgcagcaccaggttgagttcttgtcgatgaagcttgaagcagtcaattcaaggatggacatgagcccagcagtggaaggctttgttcccaaagatctcatgtcacagcattttgacggtactgggatgatgtttgcctcacaagcagcgagggattacctgcaaggatcacaagcacaaccggattggcttcatatgcagaccggtggcggatttaagagagagaca

SEQ ID NO: 96 - protein, 273 aa, Eucalyptus grandis
  Eucgr.B00385.1
MDAPLVNASSFSAANPSAYSLAEIWPLGGDTGIVGPGLRAGNLDGSVEESTVTEQSGSGRRRRRMKDASSEDESSKMVSSSCVVGSDLNNSNGAKRAKIAGSRDENGSSKAEVEANSVACNKSSAEQSAKPSEPPKQDYIHVRARRGQATDSHSLAERARREKISERMKTLQDLVPGCNKIIGKALVLDEIINYIQSLQHQVEFLSMKLEAVNSRMDMSPAVEGFVPKDLMSQHFDGTGMMFASQAARDYLQGSQAQPDWLHMQTGGGFKRET

SEQ ID NO: 97 - DNA, 822 bp, Populus trichocarpa
  POPTR_0015s07930.1
atggatcctccattgataaacgagacctccttctctgcggccaacccatcttcctacacattaactgagatttggccttttccacctcctcctccttcttccactcgtttgggcctccggatggataatttggccgacccagatgggtcccttgaggaatccactttgacagatcagagtagtggaaatggaactaggattaggaagaccagagatttcagttccgagaaggatgactcgtccaaaatggtttctaccaccactagcgccaatgatttgaatgattcaaatggtaagcggaggaaaatatcgggatcaaggagtgaaaacaacgattcaagagctgaaactgaagcaagttctgctgctaataacaagacagccgaacaaagcagtaaaccatcagagccgcctaagcaagattatattcatgtcagagcaagaaggggccaagcgactgatagccacagtttagcggagagagctcggagagaaaagattagtgagaggatgaacatgctccaagatctggtccctgggtgtaataaggttatcggcaaagcacttgtccttgatgagataattaattatatccagtcactccaatgtcaggttgagttcctctcaatgaagctagaagcagtaaattcaaggatgaacactagccccacgactgaacaccttcatccaaaagatcttggggcacagccatttgtagctactgggatgatatctggcccacaaccaacaagagaatatgttcaaggatcccaatccgaatggctacatatgcaggttggtggaagtttcgaaagagcaacg

SEQ ID NO: 98 - protein, 274 aa, Populus trichocarpa
  POPTR_0015s07930.1
MDPPLINETSFSAANPSSYTLTEIWPFPPPPPSSTRLGLRMDNLADPDGSLEESTLTDQSSGNGTRIRKTRDFSSEKDDSSKMVSTTTSANDLNDSNGKRRKISGSRSENNDSRAETEASSAANNKTAEQSSKPSEPPKQDYIHVRARRGQATDSHSLAERARREKISERMNMLQDLVPGCNKVIGKALVLDEIINYIQSLQCQVEFLSMKLEAVNSRMNTSPTTEHLHPKDLGAQPFVATGMISGPQPTREYVQGSQSEWLHMQVGGSFERAT

SEQ ID NO: 99 - DNA, 753 bp, Zea mays
  GRMZM2G008898_T01
atggatcccgcctcgtcggtggccgccgagttttggcggccgccgtaccaccacctccgggcctcgtccgtcgtcaccgccgccgcccgctccgggggcggctccagcagccgcaggagaccgcggcgcgacgccgcggcgtcgtccgaggaggagccgtccaagctcgtttccacgtcgggcaccgccgccagcagcagcgcgggctgccaggactcggctgacccagaagcaaaacggttgaaacagatagcacctagtgaaaaaaatgacagaaggacagaagctgaaacaaattcagggaacgctagcaagtctgctgataaaaagcctgcacctaaagagccaccaaaagactacatccatgtgagggctagaagaggtcaagcaacggacagccatagcctcgcagaaagagcacgacgagagaagataagtgaacggatgaaagttcttcaagatattgtccctggatgcaacaaggttatcgggaaagcatcagtccttgatgagataataaattacatccagtctttacagcgtcaagtagagtttttgtccatgaaacttgaagcgattaatgctcatgtgagcaatgcaactgtagcttttccaaccaaagattttggtgttgcgccatataatactgctcctagcctgacgttggacccacaaacgccaagggaatacgcccagggctcgatgtcagattggcttcacatgcaggtcggcaacgcatatgaaagagtgaca

SEQ ID NO: 100 - protein, 251 aa, Zea mays
  GRMZM2G008898_T01
MDPASSVAAEFWRPPYHHLRASSVVTAAARSGGGSSSRRRPRRDAAASSEEEPSKLVSTSGTAASSSAGCQDSADPEAKRLKQIAPSEKNDRRTEAETNSGNASKSADKKPAPKEPPKDYIHVRARRGQATDSHSLAERARREKISERMKVLQDIVPGCNKVIGKASVLDEIINYIQSLQRQVEFLSMKLEAINAHVSNATVAFPTKDFGVAPYNTAPSLTLDPQTPREYAQGSMSDWLHMQVGNAYERVT

SEQ ID NO: 101 - DNA, 816 bp, Populus trichocarpa
  POPTR_0012s07470.1
atggatcctccattgataaacgagaagtccttctctgcggccaacccatcttcctactcattaactgagatttggccttttcctcctccttcttcaactgctttgggcctccggatggctaatttggccgaccgagatgggtccgttgacgaatccactgtgaccgagcagaggggtggaaatagaaatggaaataggaaggctagagatttgagttccgaggaggatgactcatccataatggtttctaccaccactagtgcccatgatttgaatgatttgaatggtaagcggaggaaaatttcggggtcaaggaatgaaaacaatgattcaagagctgaaatagaagcaagttctgctgctaataacaagccagctgaaccaagcagtaaaccatctgagccgcctatgcaagactatattcatgtcagatcaagaaggggccaagcgactgatagccacagtttagcagagagagctcggagagagaggattggtgagaggatgaagatactccaagatttggtccctgggtgtaataaggtcattggtaaagcacttgcccttgatgagataattaattacatccagtcactccagtgtcaggttgagttcctctcaatgaagctagaagcagtaaattcaaggatgagcacgagccccgcgattgaaggccttcatccaaaagaccttggtgcacagccatttgatgctactggaatgatatttggcccacaaccaacaagagactatgttcaaggatcccaaccggaatggctacatatgcaggttggtggaagttttaaaagagccacg

SEQ ID NO: 102 - protein, 272 aa, Populus trichocarpa
  POPTR_0012s07470.1
MDPPLINEKSFSAANPSSYSLTEIWPFPPPSSTALGLRMANLADRDGSVDESTVTEQRGGNRNGNRKARDLSSEEDDSSIMVSTTTSAHDLNDLNGKRRKISGSRNENNDSRAEIEASSAANNKPAEPSSKPSEPPMQDYIHVRSRRGQATDSHSLAERARRERIGERMKILQDLVPGCNKVIGKALALDEIINYIQSLQCQVEFLSMKLEAVNSRMSTSPAIEGLHPKDLGAQPFDATGMIFGPQPTRDYVQGSQPEWLHMQVGGSFKRAT

SEQ ID NO: 103 - DNA, 843 bp, Arabidopsis thaliana
  AT5G62610.1
atggaccctccactagtgaacgattcctccttctctgcagctaatccttcttcttacactctctccgagatttggcctttccctgtaaacgacgccgttcgctctggtctccgtttagctgttaactccggtcgagtctttactcgctctgaacattccggcaataaagacgtctccgcggctgaggaatctacagtcaccgatctaactgctggctggggaagtagaaagactagagatttgaactctgaggatgattcttcaaagatggtttcttccagcagcagtggtaatgaattgaaagaatcaggggataagaaaagaaaactgtgtggatctgaaagtggaaatggagatggttcgatgagacctgaaggcgaaacaagttcgggtggtggtggaagcaaagcaacggaacagaagaacaaacctgagccaccaaaggattatattcatgtgagagcaagaagaggacaagctactgaccggcatagtttagcagagcgagctagaagagaaaagatcagtgagaagatgacagctcttcaagatataattccaggatgtaataagataatcggaaaagcccttgtgctcgatgagattatcaattatattcagtcattgcagcggcaagttgagtttctatcaatgaagctagaagttgttaactcgggtgcaagtactggtccgacaataggagtttttccttccggtgatctcgggactttaccgattgacgttcatcgaacaatatacgagcaacaagaagctaatgaaacccgagtatctcaaccggagtggctccatatgcaggttgatgggaactttaaccgaaccaca

SEQ ID NO: 104 - protein, 281 aa, Arabidopsis thaliana
  AT5G62610.1
MDPPLVNDSSFSAANPSSYTLSEIWPFPVNDAVRSGLRLAVNSGRVFTRSEHSGNKDVSAAEESTVTDLTAGWGSRKTRDLNSEDDSSKMVSSSSSGNELKESGDKKRKLCGSESGNGDGSMRPEGETSSGGGGSKATEQKNKPEPPKDYIHVRARRGQATDRHSLAERARREKISEKMTALQDIIPGCNKIIGKALVLDEIINYIQSLQRQVEFLSMKLEVVNSGASTGPTIGVFPSGDLGTLPIDVHRTIYEQQEANETRVSQPEWLHMQVDGNFNRTT

SEQ ID NO: 105 - DNA, 561 bp, Arabidopsis thaliana
  AT5G27910.1
atggagaacaacaacggcaacaaccagctgccaccgaaaggtaacgagcaactgaagagtttctggtcaaaagagatggaaggtaacttagatttcaaaaatcacgaccttcctataactcgtatcaagaagattatgaagtatgatccggatgtgactatgatagctagtgaggctccaatcctcctctcgaaagcatgtgagatgtttatcatggatctcacgatgcgttcgtggctccatgctcaggaaagcaaacgagtcacgctacagaaatctaatgtcgatgccgcagtggctcaaactgttatctttgatttcttgcttgatgatgacattgaggtaaagagagagtctgttgccgccgctgctgatcctgtggccatgccacctattgacgatggagagctgcctccaggaatggtaattggaactcctgtttgttgtagtcttggaatccaccaaccacaaccacaaatgcaggcatggcctggagcttggacctcggtgtctggtgaggaggaagaagcgcgtgggaaaaaaggaggtgacgacggaaac

SEQ ID NO: 106 - protein, 187 aa, Arabidopsis thaliana
  AT5G27910.1
MENNNGNNQLPPKGNEQLKSFWSKEMEGNLDFKNHDLPITRIKKIMKYDPDVTMIASEAPILLSKACEMFIMDLTMRSWLHAQESKRVTLQKSNVDAAVAQTVIFDFLLDDDIEVKRESVAAAADPVAMPPIDDGELPPGMVIGTPVCCSLGIHQPQPQMQAWPGAWTSVSGEEEEARGKKGGDDGN

SEQ ID NO: 107 - DNA, 558 bp, Arabidopsis thaliana
  AT5G50490.1
atggagaacaacaacaacaaccaccaacagccaccgaaagataacgagcaactaaagagtttctggtcaaaggggatggaaggtgacttgaatgtcaagaatcacgagttccccatctctcgtatcaagaggataatgaagtttgatccggatgtgagtatgatcgctgctgaggctccaaatctcttatctaaggcttgtgaaatgtttgtcatggacctcacgatgcgttcatggctccatgctcaagagagcaaccgactcacgatacggaaatctgatgttgatgccgtagtgtctcaaaccgtcatctttgatttcttgcgtgatgatgtccctaaggacgagggagagcccgttgtcgccgctgctgatcctgtggacgatgttgctgatcatgtggctgtgccagatcttaacaatgaagaactgccgccgggaacggtgataggaactccggtttgttacggtttaggaatacacgcgccacacccgcagatgcctggagcttggaccgaggaggatgcgactggggcaaatggaggaaacggtgggaat

SEQ ID NO: 108 - protein, 186 aa, Arabidopsis thaliana
  AT5G50490.1
MENNNNNHQQPPKDNEQLKSFWSKGMEGDLNVKNHEFPISRIKRIMKFDPDVSMIAAEAPNLLSKACEMFVMDLTMRSWLHAQESNRLTIRKSDVDAVVSQTVIFDFLRDDVPKDEGEPVVAAADPVDDVADHVAVPDLNNEELPPGTVIGTPVCYGLGIHAPHPQMPGAWTEEDATGANGGNGGN

SEQ ID NO: 109 - DNA, 606 bp, Arabidopsis thaliana
  AT5G50480.1
atggctgagaacaacaacaacaacggcgacaacatgaacaacgacaaccaccagcaaccaccgtcgtactcgcagctgccgccgatggcatcatccaaccctcagttacgtaattactggattgagcagatggaaaccgtctcggatttcaaaaaccgtcagcttccattggctcgaattaagaagatcatgaaggctgatccagatgtgcacatggtctccgcagaggctccgatcatcttcgcaaaggcttgcgaaatgttcatcgttgatctcacgatgcggtcgtggctcaaagccgaggagaacaaacgccacacgcttcagaaatcggatatctccaacgcagtggctagctctttcacctacgatttccttcttgatgttgtccctaaggacgagtctatcgccaccgctgatcctggctttgtggctatgccacatcctgacggtggaggagtaccgcaatattattatccaccgggagtggtgatgggaactcctatggttggtagtggaatgtacgcgccatcgcaggcgtggccagcagcggctggtgacggggaggatgatgctgaggataatggaggaaacggcggcggaaat

SEQ ID NO: 110 - protein, 202 aa, Arabidopsis thaliana
  AT5G50480.1
MAENNNNNGDNMNNDNHQQPPSYSQLPPMASSNPQLRNYWIEQMETVSDFKNRQLPLARIKKIMKADPDVHMVSAEAPIIFAKACEMFIVDLTMRSWLKAEENKRHTLQKSDISNAVASSFTYDFLLDVVPKDESIATADPGFVAMPHPDGGGVPQYYYPPGVVMGTPMVGSGMYAPSQAWPAAAGDGEDDAEDNGGNGGGN

SEQ ID NO: 111 - DNA, 819 bp, Solanum lycopersicum
  Solyc03g111470.1.1
atggcaagtcactctgacccgatggcagcgaatgtagaggtggcaacgtcggtgaatgcagaggctgctgctgcggcggtgaatgtaaaggcggtggcggtggcggaggcaactgctcagccggttgtaaacgcaaacaattatctcctccagcagcagttgcagttgttttgggcagctcaacttcaagagatcatgcagataggagatttcgagggtcacagtcttcccattttccgaatcaagaagatcatgaaatcggacaaggaagtccgtatgatttctgctgaatcacctattctacttgataaggcatgtgagctttttattcaggagctcacccatcgttcctggcttaaggcccaggaatgccagcgccggactctgaaaaagatcgacttctttacgacagaggaagaagctcctacttacgtgcctggcatgctgggtaacataccaaatcatatcccgtactgttactcaccaatgggacctcctgctccaccaatggcacctcttgctccatcaatgggacctcctgctccatcaatggagccacctgctccatcaatgcctgctccacccagggggatcatgggaaggcgtgctatgccttgggttactacctcaatgcacgtcccgcctccgttgtacccgcggcagttcggttggtatgctgctggcgataatccatatgctactagagggagcagtgggcagggtagcggtgatcctcaaagtggtatgatggagccaccaaggcttattggttacaggatgattagtaagcctagtggggcaatttggcgtagtggtcat

SEQ ID NO: 112 - protein, 273 aa, Solanum lycopersicum
  Solyc03g111470.1.1
MASHSDPMAANVEVATSVNAEAAAAAVNVKAVAVAEATAQPVVNANNYLLQQQLQLFWAAQLQEIMQIGDFEGHSLPIFRIKKIMKSDKEVRMISAESPILLDKACELFIQELTHRSWLKAQECQRRTLKKIDFFTTEEEAPTYVPGMLGNIPNHIPYCYSPMGPPAPPMAPLAPSMGPPAPSMEPPAPSMPAPPRGIMGRRAMPWVTTSMHVPPPLYPRQFGWYAAGDNPYATRGSSGQGSGDPQSGMMEPPRLIGYRMISKPSGAIWRSGH

SEQ ID NO: 113 - DNA, 864 bp, Solanum lycopersicum
  Solyc03g111460.1.1
atggcaagtcactctgacccggtggcagccaatgcagaggtggcggcggcggtgaatgcagaggaggaggtggcggaggcgactgctcagccgattgtgaacgcgaacgattatctccttcagcagcagttgcggttgttttgggcagctcagcttcaagagatcatacagataagagatttcaggggccacagtcttcccatttctcgaatcaagaaaatcatgaaatcggacaaggaagtccgtatgatttctgctgaatcgcctattctgcttgctaaggcatgtgagctctttattcaggagctcacccatcgttcctggcttaaggcccaagaatgtcagcgtcagactctaaaaaagattgacttatttacggtgcttaaggagactgaactctttgatttccttgtggatgtcatttctatggatgagccagaggaagaagctcctacttacgtgcctggcatgttgggtaatataccaaatcgtatctcgtactattactcaccaatgggacctcctgctccaccaatggcacctcttgctccatcagtgagacctcctgctccatcaatggggccacctgctccatcaatgcctacttcacccagggggatcatgggaaggcgtgctatgccttgggttgcaccatcaatgcacgtcccgcctccgttgtacccgcggaagttcggttggtatgctgctggcggtaatccatatttaaaggtcatgcctcttttgatccaaatgctcagtggcactggcacaacggaagctcttagtggtatgatggagccaccaaggcttattggttataggatgattagtaagcctagtggggcaatttggcgtagtggtcat

SEQ ID NO: 114 - protein, 288 aa, Solanum lycopersicum
  Solyc03g111460.1.1
MASHSDPVAANAEVAAAVNAEEEVAEATAQPIVNANDYLLQQQLRLFWAAQLQEIIQIRDFRGHSLPISRIKKIMKSDKEVRMISAESPILLAKACELFIQELTHRSWLKAQECQRQTLKKIDLFTVLKETELFDFLVDVISMDEPEEEAPTYVPGMLGNIPNRISYYYSPMGPPAPPMAPLAPSVRPPAPSMGPPAPSMPTSPRGIMGRRAMPWVAPSMHVPPPLYPRKFGWYAAGGNPYLKVMPLLIQMLSGTGTTEALSGMMEPPRLIGYRMISKPSGAIWRSGH

SEQ ID NO: 115 - DNA, 636 bp, Arabidopsis thaliana
  AT5G50470.1
atggaagagaacaacggcaacaacaaccactacctgccgcaaccatcgtcttcccaactgccgccgccaccattgtattatcaatcaatgccgttgccgtcatattcactgccgctgccgtactcaccgcagatgcggaattattggattgcgcagatgggaaacgcaactgatgttaagcatcatgcgtttccactaaccaggataaagaaaatcatgaagtccaacccggaagtgaacatggtcactgcagaggctccggtccttatatcgaaggcctgtgagatgctcattcttgatctcacaatgcgatcgtggcttcataccgtggagggcggtcgccaaactctcaagagatccgatacgctcacgagatccgatatctccgccgcaacgactcgtagtttcaaatttaccttccttggcgacgttgtcccaagagacccttccgtcgttaccgatgatcccgtgctacatccggacggtgaagtacttcctccgggaacggtgataggatatccggtgtttgattgtaatggtgtgtacgcgtcaccgccacagatgcaggagtggccggcggtgcctggtgacggagaggaggcagctggggaaattggaggaagcagcggcggtaat

SEQ ID NO: 116 - protein, 212 aa, Arabidopsis thaliana
  AT5G50470.1
MEENNGNNNHYLPQPSSSQLPPPPLYYQSMPLPSYSLPLPYSPQMRNYWIAQMGNATDVKHHAFPLTRIKKIMKSNPEVNMVTAEAPVLISKACEMLILDLTMRSWLHTVEGGRQTLKRSDTLTRSDISAATTRSFKFTFLGDVVPRDPSVVTDDPVLHPDGEVLPPGTVIGYPVFDCNGVYASPPQMQEWPAVPGDGEEAAGEIGGSSGGN

SEQ ID NO: 117 - DNA, 489 bp, Solanum lycopersicum
  Solyc03g110850.1.1
atggaaaacaactatgagaaatcagcagtgaatgcaggtcaatccgctgcgtatccaatgttgtcgccgcctcaccttgagaaaaagcaagaaaagctggagatgttttggacagacaagcggagagaaatggagaatgttattgatttcaagagcaacctgctacctcgaattcaccgcatcaagaagatcatgaagacagacaaggatgtcagaatgattgctactgaatcacctgttttgttggctaaagcatgtgagttgttcattcaagaactcactcttcgttcctggtttaaagctgaggaaaatcatcgtcgtattttgaagaaggatgacgtcactgatgtgattatggagactgacacattggatttccttcttgatgatgatgctaatgttactgacggctccacacaaaatgttgttccgttttatgttgctgaaggcacaatgggcgtacatactgataatcttgatcatcaaatg

SEQ ID NO: 118 - protein, 163 aa, Solanum lycopersicum
  Solyc03g110850.1.1
MENNYEKSAVNAGQSAAYPMLSPPHLEKKQEKLEMFWTDKRREMENVIDFKSNLLPRIHRIKKIMKTDKDVRMIATESPVLLAKACELFIQELTLRSWFKAEENHRRILKKDDVTDVIMETDTLDFLLDDDANVTDGSTQNVVPFYVAEGTMGVHTDNLDHQM

SEQ ID NO: 119 - DNA, 486 bp, Solanum lycopersicum
  Solyc03g110840.1.1
atgtctgagctttcaaacgtagagaaaaccaccatgaaaaataactctgagaaatcgatagtgaatgcagctcaatccactggataccctacgttggagatgttctggaaatcccaacagagtcaaatggagaacattaaagatttcaaggacaggttgctacttccaccaactcgtatcaagaagatcatgaagaagaacgaggatgtccgaatggtcgcgggtgaatcaccagttttgctggctaaggcatgtgagttgttcattcaagacctcacccttcgttcctcgattcacgctcaggaaaatcatcgacgtattctgaagaaggatgaccttactgatgtgattgtgcagactgactattttgattttcttcttgatgttgttcataggaatggtgcaaccgaccctttcacaccaaattctgttccgttatatgctgctggaggtagcaatgaagaggacggtaataatcttgatcaa

SEQ ID NO: 120 - protein, 162 aa, Solanum lycopersicum
  Solyc03g110840.1.1
MSELSNVEKTTMKNNSEKSIVNAAQSTGYPTLEMFWKSQQSQMENIKDFKDRLLLPPTRIKKIMKKNEDVRMVAGESPVLLAKACELFIQDLTLRSSIHAQENHRRILKKDDLTDVIVQTDYFDFLLDVVHRNGATDPFTPNSVPLYAAGGSNEEDGNNLDQ

SEQ ID NO: 121 - DNA, 414 bp, Solanum lycopersicum
  Solyc11g016920.1.1
atggaaaacaactctgagaaatcagcagtgaatgcaggtcaatctgatgtgtattcaatgttggcgctgcctcaccttgagaaaaagcaagaaaagctagagatgttttggatagacaagcagagggaaatggagaatgttattgatttcaagagcaacctgctaccttcaattaaccgcatcaagaagatcatgaagacagacaaggatgtcagaatgattgctactgaatcacctgttttgttggctaaagcatgtgagttgttcattcaagaactaactcttcgttcctggtttaaaactgagaaaaatcatcgtcgtattttgaagaaggatgacgtcactgatgtgattatggagactgacattttggatttccttcttgatgatgatgctgatgtagcttttgatgtt

SEQ ID NO: 122 - protein, 138 aa, Solanum lycopersicum
  Solyc11g016920.1.1
MENNSEKSAVNAGQSDVYSMLALPHLEKKQEKLEMFWIDKQREMENVIDFKSNLLPSINRIKKIMKTDKDVRMIATESPVLLAKACELFIQELTLRSWFKTEKNHRRILKKDDVTDVIMETDILDFLLDDDADVAFDV

SEQ ID NO: 123 - DNA, 459 bp, Solanum lycopersicum
  Solyc02g021330.1.1
atgaaaaataattttgataaactcgtagtgaatgcaactcaatcctctacgcacccaacgttggcacaacttaatattgtgaagaataaacaagaacaactggagatgttttggacaaatcagcggagagaaatagagaacgataacgagttcaagaacaatcatctactcccgcctaaccttatcaaaaagctcatgaagacggatgaggatgaccagatgattgctgctgaatcacccgttttgctagctaagacatgtgagttgttcattcaagaactcactcttcgttcctggcttaatgctcaggaaaagcatcaacatattctgaagaaggatgacgtcactgatgtgattatacagactgacaatttggattttcttcttgttgttgttgatgatgctatcgatggctccacaccaagtattgtgccattctatattgctggaggcaataat

SEQ ID NO: 124 - protein, 153 aa, Solanum lycopersicum
  Solyc02g021330.1.1
MKNNFDKLVVNATQSSTHPTLAQLNIVKNKQEQLEMFWTNQRREIENDNEFKNNHLLPPNLIKKLMKTDEDDQMIAAESPVLLAKTCELFIQELTLRSWLNAQEKHQHILKKDDVTDVIIQTDNLDFLLVVVDDAIDGSTPSIVPFYIAGGNN

SEQ ID NO: 125 - DNA, 432 bp, Solanum lycopersicum
  Solyc00g107050.1.1
atggaaaacaactctgagaaatccacagtgaatgcaactcaatccgttgatgcgtactcaacgatgtctcatcttaacattgaaaagattgagcaagaatatatggagatgttttggacagaccaggagagagaaatggagaaaattgacaatttcaagaacaatctgctagtttcacctaaccgtatcaagaacatcatgaagacgaacaaggatgtccgaaggatcacttctgaatcgcctgttttgcttgctaaggcatgtgattttttcattcaagaactcacccttcgttcctggcttaacgctcaagaaaatcatcgacgtattttgaagaagaaagatgtcaccgatgtgattaagcggaatgacaatttgaatttcctttttgatgatgatgttaattctactggaggcaacaatggacataca

SEQ ID NO: 126 - protein, 144 aa, Solanum lycopersicum
  Solyc00g107050.1.1
MENNSEKSTVNATQSVDAYSTMSHLNIEKIEQEYMEMFWTDQEREMEKIDNFKNNLLVSPNRIKNIMKTNKDVRRITSESPVLLAKACDFFIQELTLRSWLNAQENHRRILKKKDVTDVIKRNDNLNFLFDDDVNSTGGNNGHT

SEQ ID NO: 127 - DNA, 954 bp, Solanum lycopersicum
  Solyc03g111450.1.1
atggagaacaatgatcaacaacccatggagatcaatcaacaacaaccgatggagaacaatgatcaacaagccatggagatcaatcaacaacaaccaatggagaacaatgatcaacaacccatggagatcaatcaacaacaaccggtggagcctctgtaccctggttaccccttctaccaaatgctgcttcatcagcagcatcaacagctgcagctgcagctacagcagcaggtggaagagcaaatgaggattttctggaactgtcagcgtgaggaaattgaggagatggatgattttaagcatcatcactttcctatttccaggatcaagaggattataaaatctgaaaacaatgccattaagctatctgctgaaacaccgattttgttttcaaaggcatgtgagctctttgttctggagctcactcttcgttcctggtttcacgcccagcaaaacaaccgtgggtctcttaagaaaactgacttcgctgccgctattaggcggactgaggtttttgatttccttgctgacgtcgtccctgaggatgagatcaatgaagtggctactggttttgggcctggcatggtgggacccacagtaggtggtggttttccctatttttatccacctatgggactgcttgctatgcctggggtgatgccaggaggtcctgctatgcttggggtgatgccaggagggcctgctatgcttgggccgatgccaggagggcctgctatgcctgggccgatgataggagggccttctatgcctgggccgatgataggagggcctgctgtggctgtggttgctccttcagtatacgttcagcctccattgcaggcgtggcagcctgctggtgataatcccaatgctggtggagagagcgatggacagggtggtatctttcttctttttctgagaagtgacgaaggaaacgttttccgccggagggtt

SEQ ID NO: 128 - protein, 318 aa, Solanum lycopersicum
  Solyc03g111450.1.1
MENNDQQPMEINQQQPMENNDQQAMEINQQQPMENNDQQPMEINQQQPVEPLYPGYPFYQMLLHQQHQQLQLQLQQQVEEQMRIFWNCQREEIEEMDDFKHHHFPISRIKRIIKSENNAIKLSAETPILFSKACELFVLELTLRSWFHAQQNNRGSLKKTDFAAAIRRTEVFDFLADVVPEDEINEVATGFGPGMVGPTVGGGFPYFYPPMGLLAMPGVMPGGPAMLGVMPGGPAMLGPMPGGPAMPGPMIGGPSMPGPMIGGPAVAVVAPSVYVQPPLQAWQPAGDNPNAGGESDGQGGIFLLFLRSDEGNVFRRRV

SEQ ID NO: 129 - DNA, 603 bp, Glycine max
  Glyma02g09860.1
tttaagagccagcaaaagttgccgctagctagaatcagaaggatgatgaaatcagagcccggagttcagatgatcagttctgaaatccccatgctgatgtcaaaagcatgtgagattttcattcaggagctcacttttcgtgcttggatgcatgctgaaaagaacaacaagagtattgtgcagccttgtgacgttgccaaagttatcatgcaaactgataccatgaatttcctcactgagattattccaaacaacctcggcgatttcagtgtttttgatgccaagttaaaagaaatgtgtttgggtgtgttacaagaaacttgttggttaaaatataaggcttacttattattgcaggaagagaatattgcaaacattgcagaagaaaacgaagtttctctgtctttcactgctggttttatgggaaatcctatgatgaagatggacagtgtaagtaagaagaagagaatgctggaaacattgtggaaggaaaccaagctaccttaccttacacctctgattggacttaattttatacatatgtggcataaccaaaggtggcaaaatagcacaactagaggtgacaaaacaagttggtctggt

SEQ ID NO: 130 - protein, 201 aa, Glycine max
  Glyma02g09860.1
FKSQQKLPLARIRRMMKSEPGVQMISSEIPMLMSKACEIFIQELTFRAWMHAEKNNKSIVQPCDVAKVIMQTDTMNFLTEIIPNNLGDFSVFDAKLKEMCLGVLQETCWLKYKAYLLLQEENIANIAEENEVSLSFTAGFMGNPMMKMDSVSKKKRMLETLWKETKLPYLTPLIGLNFIHMWHNQRWQNSTTRGDKTSWSG

SEQ ID NO: 131 - DNA, 1332 bp, Oryza sativa
  LOC_Os01g24460.1
atgaagcaaactttggatgtacatagatcgttgaggccaccaatgccaatggctcaacaacaaatggatgaattttggagggaccgacaaaaggagattgagatgacaaaggacttcagtgagcacatgatccctatggcccgcttgaagaagatcgtatcttctcaaaagggtaacatgatgatgacctttgacatgccagcgttcttatcaaagatgtgtgagctctttgtacaagaacttgctgcgcgtgcatgggcatgtgcccaatctcataaccgatgcatcatactagacatggatattgctgaagccgtagcctctactgagtcttatgactttcttgttgatatcctccacaatcacagtgtgaagcaaaaatccactccttgttcttccaccaagcgttgtaggttagttgatcaaccttctacatctcacattccccaccaacatctgctgccacagtttgctcctacatatactttggccatccctattactcctagtttaatgccattaatttctcaatgcacaccatcctcttttccatccttgccacaagaaaagttcccattgatggcacccacacccattgtgaatagatcaatgttgtttatcaataatatagcaaggggtctgggcttacaaggaaacaatatcaatgcagttgccaacaataatatcctagacaatattgttggttgtagtagccctgcggttcttgcaagtatgatgaatcctgctttacttgggccttcaggggcaccactaaatcctccaaactcccaatcctacaactgcacaatggatataattaactccaatgatgcttgtggttccaataatagtagcgtaattgttgcaaatcaagcaaatattgctccctctggccatttttatcccattgcccttcagtcctcatgctcgacgttcttacatagtaacaacaatgacacgattactgctatactggagggtgtagatattagcgacatcatgcatgttacaagtgatgttgatgctgctacaaaggtttttagtggccaagaagaacaacatgagaaagaaactaatgttgagtggcatcatcaaaatgagatatatgaaagtattgatataagaatcatcaatgctactactagagatggtaataaatgtagtattagctgggatgaattgggaatggccgatgattcgttgctagataattttttggaggagcttcaagtaagaaaggatgatgtttcggacaccaggattgcgttcaacaaagacccattccttgatgatgctgtcttgtcaaatccaagcaccagtaatggcaacaag

SEQ ID NO: 132 - protein, 444 aa, Oryza sativa
  LOC_Os01g24460.1
MKQTLDVHRSLRPPMPMAQQQMDEFWRDRQKEIEMTKDFSEHMIPMARLKKIVSSQKGNMMMTFDMPAFLSKMCELFVQELAARAWACAQSHNRCIILDMDIAEAVASTESYDFLVDILHNHSVKQKSTPCSSTKRCRLVDQPSTSHIPHQHLLPQFAPTYTLAIPITPSLMPLISQCTPSSFPSLPQEKFPLMAPTPIVNRSMLFINNIARGLGLQGNNINAVANNNILDNIVGCSSPAVLASMMNPALLGPSGAPLNPPNSQSYNCTMDIINSNDACGSNNSSVIVANQANIAPSGHFYPIALQSSCSTFLHSNNNDTITAILEGVDISDIMHVTSDVDAATKVFSGQEEQHEKETNVEWHHQNEIYESIDIRIINATTRDGNKCSISWDELGMADDSLLDNFLEELQVRKDDVSDTRIAFNKDPFLDDAVLSNPSTSNGNK

SEQ ID NO: 133 - DNA, 1263 bp, Oryza sativa
  LOC_Os01g01290.1
atggagcaaactttggacgtacctagatcgttgaggctaccgacaccaaaggctcaacaacaaatggatgaattttggagggatcgacaaaaagagattgagacaacaaaggactttagcgagcatgcgatccctatggcccgcttgaagaagatcgcatcttctcaaaagggtaacatgatgatgtcctttgacatgccagcattcttatcgaagatgtgtgagctcttcgtacaagaacttgctgtgcgtgcatgggcatctgctcaatcccataaccgttgcatcatactagacacggatattgctgaagccattgcctccacagagtcttatgactttcttgttgatatcctccataatcaccgtgagaagcacaaatccactccttgttctacacttactacaaagcgttgtaggttagtcgatcaaccttccacatctcgcccgccctaccaacatcagctgccactgtttgctcctacatatactccagccatccctattactcctagtttaatgccaccaatttctcactatataccgttccaatatccatccttatcacaagaagtgtccacgatgatggcttccgcacccatagtgaatagatcaatgttgctcattcacaacatagcaaggggtctaggcttacaaggaaacaatatcagcacattcgccaacaataatatcccagacaatattattggttgtagtagccccgcggttcttgcaagtatgatgagtcctgctttactagacgttgcaggggcatcactaaatccgccaaactctcactccatctgcacgatgaacatgatcaactcgagtgatcccagtggatctagcattggtgacattaatgttgcaaatcaagcaagtcttgctccctctgaacattttaaccctgctatccttcaagagtcctcatgtccttcgttcttatataataacaacaatgacacgattgttgttgtaccggagggtgtagatattagtggcaccatggatgttgctggtttagttatcaatggtcaagaagaagaacatgagaggaaaacaaatgttgagcaaaatgagatatatgaaagcattgatataggaataatcaatgcaagtgttgcggatggtaataaatgcagtattaggtgggatgaattaggaacggccgatgattcattgctagataaatttttggaggagtttcaagcaagaaacgacggtgttttgcacagcgggattgtgttgcatgaagaccattcc

SEQ ID NO: 134 - protein, 421 aa, Oryza sativa
  LOC_Os01g01290.1
MEQTLDVPRSLRLPTPKAQQQMDEFWRDRQKEIETTKDFSEHAIPMARLKKIASSQKGNMMMSFDMPAFLSKMCELFVQELAVRAWASAQSHNRCIILDTDIAEAIASTESYDFLVDILHNHREKHKSTPCSTLTTKRCRLVDQPSTSRPPYQHQLPLFAPTYTPAIPITPSLMPPISHYIPFQYPSLSQEVSTMMASAPIVNRSMLLIHNIARGLGLQGNNISTFANNNIPDNIIGCSSPAVLASMMSPALLDVAGASLNPPNSHSICTMNMINSSDPSGSSIGDINVANQASLAPSEHFNPAILQESSCPSFLYNNNNDTIVVVPEGVDISGTMDVAGLVINGQEEEHERKTNVEQNEIYESIDIGIINASVADGNKCSIRWDELGTADDSLLDKFLEEFQARNDGVLHSGIVLHEDHS

SEQ ID NO: 135 - DNA, 1326 bp, Oryza sativa
  LOC_Os01g39850.1
atggagcaaactttggacgtacctagatcgttgagactactggcgccaaaagctcaacaacaaatggatgaattttggagggatcgacaaaaggagattgaaacaacaaaggactttagcgagcatgcgatccctatggcccgcttgaagaagatcgtatcttctcaaaagggtaacatgatgatgacctttgacatgccagcattcttatcgaagatgtgtgagctcttcgtacaagaacttgctgtgcgtgcatgggcatctgctcaatcccataatcgttgcatcatactagacacggatattgctaaagccattgcctccacagagtcttatgactttcttgttgatatcctccataatcatcgtgtgaaacacaaatccactccttgttctacacttactacaaagcgttgtaggttagtcgatcaaccttccacatctcacatgccctaccaacatcagctgccacaatttgctcctacatatactccggccatccctattactcctagtttaatgccaccaatttctcactatataccgttccaatatccatccttatcacaagaagtgtccccgatgatggcttctgcacccatagtgaatagatcaatgttgctcattcacaacatagcaaggggtctaggcttacaaggaaacaatatcagcacgttcgccaacaataatatcccagacaatattgttggttgtagtagccccacagttcttgcaagtatgatgagtcctgctttactagaagttgcagggacatcactaaatccaccaaactctcattccatctgcacaatgaacatgatcaactcgagtgatcctagtggatctagtattggtgacattaatgttgcaaatcaagcaagtcttgctccctctggacgttttaaccctgctatccttcgagagtcatcatgtccttcgttcttacatagtaacaatgacacaattgttgctataccggagggtgtagatattagtggcaccatggatgttgctagtgatgttgctgctatagttatcaatggtcaagaagaacatgagagggaaacaaatgttgagcatcatcagcaaaatgagatatatgaaagcattgatataggaataatcaatgcaagtgttgcggatgataataaatatagtattagctgggatgaattgggaatggctgatgattcattgctagacaaatttttggaggagtttcaagtaagaaatgacggtgttttgcgcactgggattgagttgcatgaagacccattccttggtgacgtgatgttagcaaacccaagtacaagcaatgccaataag

SEQ ID NO: 136 - protein, 442 aa, Oryza sativa
  LOC_Os01g39850.1
MEQTLDVPRSLRLLAPKAQQQMDEFWRDRQKEIETTKDFSEHAIPMARLKKIVSSQKGNMMMTFDMPAFLSKMCELFVQELAVRAWASAQSHNRCIILDTDIAKAIASTESYDFLVDILHNHRVKHKSTPCSTLTTKRCRLVDQPSTSHMPYQHQLPQFAPTYTPAIPITPSLMPPISHYIPFQYPSLSQEVSPMMASAPIVNRSMLLIHNIARGLGLQGNNISTFANNNIPDNIVGCSSPTVLASMMSPALLEVAGTSLNPPNSHSICTMNMINSSDPSGSSIGDINVANQASLAPSGRFNPAILRESSCPSFLHSNNDTIVAIPEGVDISGTMDVASDVAAIVINGQEEHERETNVEHHQQNEIYESIDIGIINASVADDNKYSISWDELGMADDSLLDKFLEEFQVRNDGVLRTGIELHEDPFLGDVMLANPSTSNANK

SEQ ID NO: 137 - DNA, 720 bp, Arabidopsis thaliana
  AT3G60530.1
atggacgtctacggcatgtcttcaccggacttgcttcgtatcgacgaccttctcgatttctccaacgacgaaatcttctcttcctcttccaccgtcacttcctccgccgcttcctccgccgcttcttccgaaaaccctttcagctttccttcttccacctacacttctcctactctcctcaccgacttcactcacgatctctgcgttcccagtgacgacgcagctcatctcgaatggttatcgcgattcgttgacgattcattctccgatttcccagcaaatcctttaaccatgaccgttagacccgagatttcattcaccggaaaacctagaagtcgccgatcaagagcaccagcaccttccgtagctggaacttgggctccgatgtctgaatcagagctttgtcactccgtcgctaaacctaaaccgaagaaagtctacaacgctgaatcggttacggcggatggagcgaggcggtgcacgcactgtgcctcggagaaaacgccacagtggagaactggaccgcttggacctaaaacactttgtaacgcttgtggagttcgttacaaatcagggaggcttgtaccggaatacagaccggcgtcgagtccgacgtttgtattgactcagcattcgaactctcatcggaaagttatggagctccggcgacagaaggaacaacaagaatcttgcgttcgaattccgccgtttcagccgcag

SEQ ID NO: 138 - protein, 240 aa, Arabidopsis thaliana
  AT3G60530.1
MDVYGMSSPDLLRIDDLLDFSNDEIFSSSSTVTSSAASSAASSENPFSFPSSTYTSPTLLTDFTHDLCVPSDDAAHLEWLSRFVDDSFSDFPANPLTMTVRPEISFTGKPRSRRSRAPAPSVAGTWAPMSESELCHSVAKPKPKKVYNAESVTADGARRCTHCASEKTPQWRTGPLGPKTLCNACGVRYKSGRLVPEYRPASSPTFVLTQHSNSHRKVMELRRQKEQQESCVRIPPFQPQ

SEQ ID NO: 139 - DNA, 792 bp, Arabidopsis thaliana
  AT2G45050.1
atggacgtctatggcttatcttcaccagacttacttcgaatcgacgaccttcttgatttctccaacgaagacatcttctccgcttcttcttccggtggttccaccgccgctacttcctcttcttctttccctcctcctcaaaaccctagtttccaccaccaccatctcccttcctccgccgatcatcactccttcctccacgacatttgcgttcccagtgatgacgcagctcatcttgaatggctttcgcaattcgtggacgattctttcgctgattttccggcgaatccattaggaggaactatgacttctgtcaaaactgaaacttcctttccggggaaaccaagaagcaaacgatcaagagctcctgctcctttcgccggaacatggtctccgatgccactggaatccgagcatcagcagcttcactccgccgccaaattcaagccaaagaaagaacaatccggcggaggaggaggaggaggaggaagacatcagtcatcgtcatcggagactacggaaggaggaggaatgaggagatgtactcactgtgcatcggagaaaacgccacagtggaggacaggaccacttggacctaaaacactatgtaacgcttgtggagtccggtttaaatccggtagacttgtaccggaatatagaccggcttcgagtcctacttttgttttgactcagcattcaaactctcaccggaaagtgatggagcttcgacggcagaaagaagttatgagacaaccacaacaagttcaacttcatcaccaccaccacccgttt

SEQ ID NO: 140 - protein, 264 aa, Arabidopsis thaliana
  AT2G45050.1
MDVYGLSSPDLLRIDDLLDFSNEDIFSASSSGGSTAATSSSSFPPPQNPSFHHHHLPSSADHHSFLHDICVPSDDAAHLEWLSQFVDDSFADFPANPLGGTMTSVKTETSFPGKPRSKRSRAPAPFAGTWSPMPLESEHQQLHSAAKFKPKKEQSGGGGGGGGRHQSSSSETTEGGGMRRCTHCASEKTPQWRTGPLGPKTLCNACGVRFKSGRLVPEYRPASSPTFVLTQHSNSHRKVMELRRQKEVMRQPQQVQLHHHHHPF

SEQ ID NO: 141 - DNA, 765 bp, Vitis vinifera
  GSVIVT01018180001
atggacttgtacggtctacagacgtccgacttttttcgtatcgatgacctacttgactttactaatgacgaactcttctcctccactaccactgattccggcaatctccctccgccggagatagcctccggcaaccgctctttggcggcctccggcaaccgcgaccagcctaatacttttcattctgctgatttcactgacgacctctgtgttcctagtgatgatgttgctgagctcgagtggctttcgaacttcgtggacgactcatttgcggattttccggagaatgaactcgccggaaccgtaatggcccggcctgactcatcatttccagggcggacacgtagtaagcggtccagagcatcgtcgacgaacaaagtatggacttcctcatcgtcatcatctgtgattagcggagagagatcctcgtcctcgtcgccggcatcgtcgcccacgggagcgcgtaagtgcacgcactgcgcttcggagaaaacgccacagtggcgcacgggtcctctaggtccaaaaacactatgcaacgcgtgcggcgtgcgttacaagtcaggccgactggttccggagtaccgacctgcagcgagtccaacgtttgtgctgactcagcactcgaactcgcaccgcaaggtgatggagctccgtcgccagaaggaaatcctccggcaacagcaacaacaacaacagctctaccatcaccaccacgacttcgaggaagtttcattaaattttcttttctttgctttgatgctt

SEQ ID NO: 142 - protein, 255 aa, Vitis vinifera
  GSVIVT01018180001
MDLYGLQTSDFFRIDDLLDFTNDELFSSTTTDSGNLPPPEIASGNRSLAASGNRDQPNTFHSADFTDDLCVPSDDVAELEWLSNFVDDSFADFPENELAGTVMARPDSSFPGRTRSKRSRASSTNKVWTSSSSSSVISGERSSSSSPASSPTGARKCTHCASEKTPQWRTGPLGPKTLCNACGVRYKSGRLVPEYRPAASPTFVLTQHSNSHRKVMELRRQKEILRQQQQQQQLYHHHHDFEEVSLNFLFFALML

SEQ ID NO: 143 - DNA, 789 bp, Citrus clementina
  clementine0.9_018978m
atggatatctacggtctcccttctaataacactaccactcaagacttgtttcgcattgacgaccttcttgatttctccaacgacgaactcttcacctcctcatcttccgccgccactgcaaacaccaccgccatcgcctccgacaccgaccacctccctcaggcgcaacaccagtcttttgactcctttaatccctcctctgacttcacaggcgacctctgtgtccccagtgatgacgtggcggagctggagtggttgtcgcagttcgtagacgattcctgcatggactttccagcaaactcccttgccggaacgatcgtccgatcagacacgtcattatcaggaagaggacgaagcaagcgttcaaaagcgacaaattcggcagctaacacgaccacgtggaactggacgtcatccgaatctgagtctggaaattcgaagcagaagcgagagaatcaccggcaatcgtcgccgattccagaaggcggagtgaggaggtgcacgcactgcgcatcggagaagacgccacagtggcggacgggacctctcggccctaagactctttgtaacgcgtgtggcgtacgctacaagtcgggtcggctcgtgcctgaataccgaccagcttcgagcccgacgtttgtgctgactcagcactcgaattcgcatcgcaaggtcttggagcttcgaaggcaaaaggaactgttgaggcagcaacaattacagcagcagcagcagcaggaggaagggcaggggcaaatctatcgtcaccagcgtgactttgaagtatgc

SEQ ID NO: 144 - protein, 263 aa, Citrus clementina
  clementine0.9_018978m
MDIYGLPSNNTTTQDLFRIDDLLDFSNDELFTSSSSAATANTTAIASDTDHLPQAQHQSFDSFNPSSDFTGDLCVPSDDVAELEWLSQFVDDSCMDFPANSLAGTIVRSDTSLSGRGRSKRSKATNSAANTTTWNWTSSESESGNSKQKRENHRQSSPIPEGGVRRCTHCASEKTPQWRTGPLGPKTLCNACGVRYKSGRLVPEYRPASSPTFVLTQHSNSHRKVLELRRQKELLRQQQLQQQQQQEEGQGQIYRHQRDFEVC

SEQ ID NO: 145 - DNA, 780 bp, Solanum lycopersicum
  Solyc01g090760.2.1
atggatgtctacggtctgcactctgcacctgacttgtttcgtatcgatgatctactcgatttctctaacgacgaaattttctccattaataacaactccaacaacaccgactctaaccaccaccatcaacctcactcacacaactcctccgccgccggacccgccaattattacgatgctcttcttcctaattcttccgacgatttcactgataacctctgcgttcccagtgatgatgtagcggagttggaatggttatcgaactttgtagaagattcgtttagtaattttccggctaattccgtaaccggaacgatgaatatcacttccaatactgcgtcgtttcatggaaggtcgagaagcaaacgttctcgttctacttcaagctggacatcctcactacagaactctaatgctactacttctgtgaagaacaaggagagttcagtatataccagagaaaggtcgtcttcaatggacgaagatgtgccacggagatgcacacactgcgcttcggagaagacgccgcagtggagaactggtcctctaggcccaaaaacactctgcaatgcttgtggagttaggtacaaatcaggccggctagttccggaataccgccccgcagctagtccaacttttgtgttaacacagcactcaaattctcaccggaaagttatggagctccgtcgacagaaggaaatgatccatcaaccgcagcagcaacaacaaatgccgccgtcgacagaggagggaatgtacggacatcactttcgggtctgc

SEQ ID NO: 146 - protein, 260 aa, Solanum lycopersicum
  Solyc01g090760.2.1
MDVYGLHSAPDLFRIDDLLDFSNDEIFSINNNSNNTDSNHHHQPHSHNSSAAGPANYYDALLPNSSDDFTDNLCVPSDDVAELEWLSNFVEDSFSNFPANSVTGTMNITSNTASFHGRSRSKRSRSTSSWTSSLQNSNATTSVKNKESSVYTRERSSSMDEDVPRRCTHCASEKTPQWRTGPLGPKTLCNACGVRYKSGRLVPEYRPAASPTFVLTQHSNSHRKVMELRRQKEMIHQPQQQQQMPPSTEEGMYGHHFRVC

SEQ ID NO: 147 - DNA, 711 bp, Glycine max
  Glyma07g14750.1
atggacttgtacggttccttttccaccccttcagattgcttacatattgatgattttctagatttctccaacatcaccaccgacacccaccaccaccttcctcctccgcaaaactctccattaatctcccacgacgacgccaatctcttcttcaatttcccttccgttccgaccgacgaagcggcggagctggagtggctctcccagttcgtggacgacgacgcgacgtcgtttcacagcttcccagcaaccgcatcgattggatcccactcgacgtcgtttctctccaacaataacaacagaaacgataataacgaatatcccaaatcttcattatcttcaaacattccatgttcttcagcggtggcgggaaaatcgagagcgaggagggaagggtcggttaccggcgacggcggcgtgcggcggtgcagccactgtgcctcggagaagacgccgcagtggcgcgcgggaccgctgggaccgaagacgctgtgcaacgcgtgcggggttcggttcaagtcgggtcggctcgtacccgaataccgacccgcggcgagccctacgttcgtgctgactcagcattcgaactcgcaccgcaaggtcatggagctccgtcgccagaaggagctgctccgccaccaacaacaacaacaattacaacaagagcaatgccaccgtcacactcacaaccaccacgatttcaaagtttgc

SEQ ID NO: 148 - protein, 237 aa, Glycine max
  Glyma07g14750.1
MDLYGSFSTPSDCLHIDDFLDFSNITTDTHHHLPPPQNSPLISHDDANLFFNFPSVPTDEAAELEWLSQFVDDDATSFHSFPATASIGSHSTSFLSNNNNRNDNNEYPKSSLSSNIPCSSAVAGKSRARREGSVTGDGGVRRCSHCASEKTPQWRAGPLGPKTLCNACGVRFKSGRLVPEYRPAASPTFVLTQHSNSHRKVMELRRQKELLRHQQQQQLQQEQCHRHTHNHHDFKVC

SEQ ID NO: 149 - DNA, 768 bp, Solanum lycopersicum
  Solyc10g018560.1.1
atggatgtctacggacggttaacgccagaagtgtttcgaattgatgattttcttgatttctcaaacgaagaagacatcttttcctcctctaaaaccgccatcgattttgatctcaatcaccattatcaaccacctcctaccgacagcattgctgataccggttgttactaccatgctcctcccaattccgttgacttcaccgacaaactctgcgttccgagtgatgatgtagcagaattggagtggttatcgaacttcgtggaagattcatccaataatttcccttcaaacaacttaacacaaaccatgtaccacctcaataataccaatacaatattgcacagcaaatcaagaagtaaacgttcacgtaattcaaacagtactagctggaatacttcctcactccaacgacacaaatccgcaaaccaaaaaaactccaatcaagacgagaattcgggagattataacagtaacaagctttcaaataactcaaaaattattacatcgcgaaaatgcacccattgtgcatcagagaaaacaccgcagtggcgaacaggcccattgggcccaaaaacattgtgtaatgcttgtggtgtaaggtacaaatcgggccgattggtacctgaatatcgacccgcggcaagcccgacctttgtgttgacacaacattcgaattctcacaggaaagtaatggaactccggcgacagaaagagattattgatcaacagcagcagcacggaatgtatggacatcactatccggtatgc

SEQ ID NO: 150 - protein, 256 aa, Solanum lycopersicum
  Solyc10g018560.1.1
MDVYGRLTPEVFRIDDFLDFSNEEDIFSSSKTAIDFDLNHHYQPPPTDSIADTGCYYHAPPNSVDFTDKLCVPSDDVAELEWLSNFVEDSSNNFPSNNLTQTMYHLNNTNTILHSKSRSKRSRNSNSTSWNTSSLQRHKSANQKNSNQDENSGDYNSNKLSNNSKIITSRKCTHCASEKTPQWRTGPLGPKTLCNACGVRYKSGRLVPEYRPAASPTFVLTQHSNSHRKVMELRRQKEIIDQQQQHGMYGHHYPVC

SEQ ID NO: 151 - DNA, 1083 bp, Zea mays
  GRMZM2G113098_T01
atggcgtcggagtgggaaatggccatgggggtggagctcggcatgggaatgggcacgtaccactaccaccacaacgcctccagcatcaccaccgcgccgatgagcagccaccacagcggcggcgccagctactccacgccgcaccaccaccactactatgggatgccgcccacgggcggcgccggcgacgccatgcgcgtggacgaccttctcgacctctccaccggcgccggcgccggcgcccacgagttcttccccaccgcgcctgcgcccgcgaccactgacaaggggcaccaccacccgggagccatgggtgagccgtcacccaccgccgccaactcgtcggatcaccagacgtcgctcctctccttcgccgatgagttctacatacccagcgaggaagctgccgagctggagtggctatccaagttcgtggacgactcctactcggacatgcccaattactcgtcggcggccgcgcacgccgcaatggcggcggcggcagcaggcaacggaggaggcggcacctcggccggccaagacagctgcgtcaccgcggcgccagctggccgcggcgcgcgtagcaagcggtcctcccgcgcgcccgcggcggcggcgtggcactccctcgtgtcgcgcccaccgtcgcagccgtcgccatcctcgtcgtcctgctcgtcttcggacttcccgtcgtcgtccaacaggccagcgcgcggcaggaagagcccggggcccggcggggacgcggtggcgggctcggacggcggcgtgcggcggtgcacgcactgcgcgtcggagaagacgccgcagtggaggacggggccgctgggccccaagaccctgtgcaacgcgtgcggcgtgcgcttcaagtccgggcggctcgtgcccgagtaccgccctgcggccagccccaccttcgtgctcacgcagcactccaactcgcaccgcaaggtcatggagctgcgccgccagaaggagctcatcctcatccgcggaagccaccgcgacgccgccgcggctgcaggagcaggatccgccgggccgaggccggagctcatgttccgcgactacggcgtgtgt

SEQ ID NO: 152 - protein, 361 aa, Zea mays
  GRMZM2G113098_T01
MASEWEMAMGVELGMGMGTYHYHHNASSITTAPMSSHHSGGASYSTPHHHHYYGMPPTGGAGDAMRVDDLLDLSTGAGAGAHEFFPTAPAPATTDKGHHHPGAMGEPSPTAANSSDHQTSLLSFADEFYIPSEEAAELEWLSKFVDDSYSDMPNYSSAAAHAAMAAAAAGNGGGGTSAGQDSCVTAAPAGRGARSKRSSRAPAAAAWHSLVSRPPSQPSPSSSSCSSSDFPSSSNRPARGRKSPGPGGDAVAGSDGGVRRCTHCASEKTPQWRTGPLGPKTLCNACGVRFKSGRLVPEYRPAASPTFVLTQHSNSHRKVMELRRQKELILIRGSHRDAAAAAGAGSAGPRPELMFRDYGVC

SEQ ID NO: 153 - DNA, 1161 bp, Oryza sativa
  LOC_Os10g40810.1
atggcgtcggagtgggaaatggccatgggcgtcgacctcggcatggggatgagcacgtaccacaacgcctccggtggcatcgccgccgcgccgatgatgggccaccacggcggaggaggcggcggcggcgggtactccgccgcgcaccaccaccaccaccattactacgggatgcctcatcaggcggcgatgggcgacgccatgcgcgtcgacgacctcctcgacctctccaacactcccggcgcccacgacttcttcccggcctccgctgccgccgccgccgcaggtgaccacgggcaccaccaccaccaccacatcggcggcatgggcgagccgtcgggcgccacgccgtcggccacgtcgtcagatcaccagacgtcgatgctctccttcgccgacgacttctacatacccaccgaggacgctgccgagctggagtggctatccaagttcgtcgacgactcctactccgacatgccgaattaccagtcgtccgcgcacgccgcaatggcggcggcggctgcttccgcggccaacaacggcggcggcagctcggccggccaagacagctgcctcacggcggcgcctggccgcggcgcccgtagcaagaggtcgcgcgcgacggccgcggccgccgccgcgtggcactccctcgtcccgcgcccgccgtcccagtcgtcgccgtcgtcgtcgtgctcgtcgtccgacttcccgtcctcgaacaagccatcgggcaccgcgaggccgaacggctcaggaggcggcagccgcggcaagaagagccccggccccgcgggggcggaggtgggcatggaggccggcgtgcggcggtgcacgcactgcgcgtcggagaagacgccgcagtggcggacggggcccctgggccccaagaccctgtgcaacgcgtgcggcgtgaggttcaagtccgggcggctgatgccggagtacaggccggcggcgagccccacgttcgtgctgacgcagcactccaactcccaccgcaaggtcatggagctgcgccgccagaaggagctcctcatcatccgcggcagccaccgcgacgccgccgcggccgcagcagcagccgccgccgccgccgccgcgggatccgccgcggcgaccgggaggccggagctcatgttccgcgactacggcgtgtgc

SEQ ID NO: 154 - protein, 387 aa, Oryza sativa
  LOC_Os10g40810.1
MASEWEMAMGVDLGMGMSTYHNASGGIAAAPMMGHHGGGGGGGGYSAAHHHHHHYYGMPHQAAMGDAMRVDDLLDLSNTPGAHDFFPASAAAAAAGDHGHHHHHHIGGMGEPSGATPSATSSDHQTSMLSFADDFYIPTEDAAELEWLSKFVDDSYSDMPNYQSSAHAAMAAAAASAANNGGGSSAGQDSCLTAAPGRGARSKRSRATAAAAAAWHSLVPRPPSQSSPSSSCSSSDFPSSNKPSGTARPNGSGGGSRGKKSPGPAGAEVGMEAGVRRCTHCASEKTPQWRTGPLGPKTLCNACGVRFKSGRLMPEYRPAASPTFVLTQHSNSHRKVMELRRQKELLIIRGSHRDAAAAAAAAAAAAAAGSAAATGRPELMFRDYGVC

SEQ ID NO: 155 - DNA, 1101 bp, Setaria italica
  Si036273m
atggcatcggagtgggaaatggccatgggagtggagctcggcatggggatgggcacgtaccacggccaccacaacgcctccagcatcaccaccgcgccgatgagcagccaccacagcggtggcgccagctactccacggcgcatcaccaccattactacgggatgccgcccatgggcgacgccatgcgcgtcgacgaactcctcgacctctccaccggcgccggcgcccacgacttcttccccaccgccgcgggggccgcggctgctgacaacgggcatcactcgggagctatgggtgagccgtcgcccaccgccaactcgtcggatcaccagacgtcgctcctctccttcgccgacgagttctacatacccagcgaggaagctgcggagctggagtggctatccaagttcgtggacgactcctactccgacatgccgaattactcctcgcatgccgcaatggcggcggccgctgctgctaacgcggccggcaacggtggtggcaactcgggtggtcaggacagctgcgtcacggccgcgcctggccgcggcgcgcgtagcaagcgttcccgcgcgaccgccgcggctgccgcggcgtggcactccctcgtgccgcgcccgccatcgcagtcgtcgccatcatcgtcctgctcgtcctcggacttcccgtcgtcgaacaagccggggcggccgaatggcgccaacggcagccgcggcaagaagagcccgggccccgggggggccgcgggggcggaggtgggcatggagggcggcgtgcggcggtgcacgcactgcgcgtcggagaagacgccgcagtggcggaccgggcccctgggccccaagaccctgtgcaacgcgtgcggcgtgcggttcaagtccgggcgcctcatgccggagtacaggccggcggccagccccacgttcgtgctgacgcagcactccaactcgcaccgcaaggtgatggagctgcgccgccagaaggagctgatcctcatccgcggcagccaccgcgacgcggccgcggccgccgcggctgcctcggcggccgcaggatccgccgggccgaggccggagctcatgttccgcgactacggcgtgtgt

SEQ ID NO: 156 - protein, 367 aa, Setaria italica
  Si036273m
MASEWEMAMGVELGMGMGTYHGHHNASSITTAPMSSHHSGGASYSTAHHHHYYGMPPMGDAMRVDELLDLSTGAGAHDFFPTAAGAAAADNGHHSGAMGEPSPTANSSDHQTSLLSFADEFYIPSEEAAELEWLSKFVDDSYSDMPNYSSHAAMAAAAAANAAGNGGGNSGGQDSCVTAAPGRGARSKRSRATAAAAAAWHSLVPRPPSQSSPSSSCSSSDFPSSNKPGRPNGANGSRGKKSPGPGGAAGAEVGMEGGVRRCTHCASEKTPQWRTGPLGPKTLCNACGVRFKSGRLMPEYRPAASPTFVLTQHSNSHRKVMELRRQKELILIRGSHRDAAAAAAAASAAAGSAGPRPELMFRDYGVC

SEQ ID NO: 157 - DNA, 1116 bp, Zea mays
  GRMZM2G110295_T01
atggcgtcggagtgggaaatggccgccatgggggtggagctcggcatgggaatgggcggcacgtaccaccacaacgcctccagcatcaccacggcgccgacgagcagccaccacagcggcggcgccgggtactccgcggcgcaccaccaccattactacggcatgccgcccgtgggcggcgacgccacggccatgcgcgtggacgaccttctcgagaatctcgacctctccaccggcgctggcgcccacgagttcttccccaccgcggctgctgccaacaagggacaccaccactcggggggcgccatggtcggtgagccgtcgcccacggccaactcgtcggaccaccagacgtcgctcctctccttcgccgacgagttctacatacccagcgaggaagctgccgagctggagtggctgtccaagttcgtggacgactcctactcggacatgccgaattactcgtcggccacgcacgccgcaatggcagcagcggcagcggcagcggctgcggctgcgaacaccgccggcactagagcaggaggcacctcgggcgggcaggacagctgcgccaccgcggcgcccggccgcggcgcgcgcagcaagcggtcgtcccgcgcggccgccgcggcgtggcactccctcgtgccgcgcccgccatcgcagccgtccccgtcaacgtcctgctcgtcctcggacttcacgccggcgtcgacgaacaacaagccggcacgcccgagcaacggcggcagccgcggcaggaagagcccggggcccgccggggaggtagtggcagtgggcgtggagggcggcgtgcgccggtgcacgcactgcgcgtcggagacgacgccgcagtggcggacggggccgctgggccccaagaccctgtgcaacgcgtgcggcgtgcggttcaagtccgggcggctggtgcccgagtaccgccccgcgtccagccccaccttcgtgctcacgcagcactccaactcgcaccgcaaggtcatggagctgcgccgccagaaggagctcgtcctcatccgcggaacccaccgtgacgcttcggcggcagcggcgggatccgccgggccggagctcatgttccgtgactacggcgtgtgt

SEQ ID NO: 158 - protein, 372 aa, Zea mays
  GRMZM2G110295_T01
MASEWEMAAMGVELGMGMGGTYHHNASSITTAPTSSHHSGGAGYSAAHHHHYYGMPPVGGDATAMRVDDLLENLDLSTGAGAHEFFPTAAAANKGHHHSGGAMVGEPSPTANSSDHQTSLLSFADEFYIPSEEAAELEWLSKFVDDSYSDMPNYSSATHAAMAAAAAAAAAAANTAGTRAGGTSGGQDSCATAAPGRGARSKRSSRAAAAAWHSLVPRPPSQPSPSTSCSSSDFTPASTNNKPARPSNGGSRGRKSPGPAGEVVAVGVEGGVRRCTHCASETTPQWRTGPLGPKTLCNACGVRFKSGRLVPEYRPASSPTFVLTQHSNSHRKVMELRRQKELVLIRGTHRDASAAAAGSAGPELMFRDYGVC

SEQ ID NO: 159 - DNA, 1083 bp, Brachypodium distachyon
  Bradi3g33200.1
atggcgtcggagtgggaaattgccatgggcgtggagctcggcatgggaatgggcgcgtacaacaccacctccagcgccggcgccgctgcaccgatgggccaccacgcgggcggcggctaccatttctacgggatgcagccgatgggcgccgccgacccttccatgcgcgtggacgagctcctcgacctctccagcgccggcgccggcgcgcacgacttcttccccgccgccgccgcggacaacgggcactaccactaccaccacctcggccccggcgtcggcgagccgtcggcggccactactccgtccgccacgtcgtcggatcaccagacgtccatgctctccttcgccgacgagttctacatacccagcgaggaggccgcggagctggagtggctatccaagttcgtggacgactcctactccgacatgccgaattactcctcggccgcacacgcggcaatggcgaaggctgctgccgcggccagtaacagcccggctggtcagcatggcagctgcatcacagcggcggctccgccgggccgcggcgcgcggagcaagcggtcccgtgcgagcgccgcggccgccgccgcgtggcactccctgatgccgcgcccgccttcgcagtcatcgccttcctcctcgtcctgctcgtcgtccgacatcccggcgtcctcgaacaagccggcccggcccaacaacagcaacggcagccgcggcaagaagcagggcccccccgtggcggaccagtccgtgggcctggtggagggaggcgtgaggcggtgcacgcactgcgcgtcggagaaaacgccgcagtggcggacgggcccgctggggcccaagacgctgtgcaatgcctgcggggtacggttcaagtcgggccggctggtgcccgagtaccggccggcggccagcccgacgttcctgctcacgcagcactccaactcgcaccgcaaggtcatggagctccgccggcagaaggagatcgtcctcatccgcggcagccacccctcggtgccgacggggcccgccggggcggcgaccgtgaagccggagctcctcttccgtgactacggcatctgt

SEQ ID NO: 160 - protein, 361 aa, Brachypodium distachyon
  Bradi3g33200.1
MASEWEIAMGVELGMGMGAYNTTSSAGAAAPMGHHAGGGYHFYGMQPMGAADPSMRVDELLDLSSAGAGAHDFFPAAAADNGHYHYHHLGPGVGEPSAATTPSATSSDHQTSMLSFADEFYIPSEEAAELEWLSKFVDDSYSDMPNYSSAAHAAMAKAAAAASNSPAGQHGSCITAAAPPGRGARSKRSRASAAAAAAWHSLMPRPPSQSSPSSSSCSSSDIPASSNKPARPNNSNGSRGKKQGPPVADQSVGLVEGGVRRCTHCASEKTPQWRTGPLGPKTLCNACGVRFKSGRLVPEYRPAASPTFLLTQHSNSHRKVMELRRQKEIVLIRGSHPSVPTGPAGAATVKPELLFRDYGIC

SEQ ID NO: 161 - DNA, 753 bp, Populus trichocarpa
  POPTR_0014s05760.1
atggatgtctatggaggattgtctaccaccactgcacctgattatttccacattgatgaccttttagacttctctaatgacgacctcctctcctcaccctcctcctccatcgaccaccaccaccaccttcctccacctgaaacctcctccattcatcaccaccacttcccctcctccacctatattaataacccttcttctctctccactgacttcactgaccatctctcagtcccaaccgatgacgtggcagagctagagtggctatcgcaattcgtggaggactcgttctccgactttccgagcatcattaatatcccaaccgacacgtcgttttgcaacaaatctcgcagcaaacgctcacgagccaccgccaccaccgcgacgtcctcctcgccggagctcgaaactgcggtgaccggaaaatcgagattgaagaaggaaaacaacggagcgccgcattctccggcggaggaggggacagtgcggaggtgcacgcactgcgcgtctgagaagactcctcagtggaggacgggtccgctgggtccaaaaacgctatgcaatgcctgtggagtcaggtataagtcgggtcggcttgtaccagaatatcgacccgcagcgagtccgacttttgtgttgactcggcattcgaactcgcaccgtaaagttttggagctccgaagacagaaagagatgacggtggggcggcagcagcagcagcagcagcacggttaccaaggctatgaagtttgc

SEQ ID NO: 162 - protein, 251 aa, Populus trichocarpa
  POPTR_0014s05760.1
MDVYGGLSTTTAPDYFHIDDLLDFSNDDLLSSPSSSIDHHHHLPPPETSSIHHHHFPSSTYINNPSSLSTDFTDHLSVPTDDVAELEWLSQFVEDSFSDFPSIINIPTDTSFCNKSRSKRSRATATTATSSSPELETAVTGKSRLKKENNGAPHSPAEEGTVRRCTHCASEKTPQWRTGPLGPKTLCNACGVRYKSGRLVPEYRPAASPTFVLTRHSNSHRKVLELRRQKEMTVGRQQQQQQHGYQGYEVC

SEQ ID NO: 163 - DNA, 738 bp, Populus trichocarpa
  POPTR_0002s14380.1
atggatgtctatggaggagtctctaccagcgcacctgattattttctcattgatgaccttttagacttctctaatgatgaccttctcacctcctccacggaccaccaccaccttcctccacctgaaacctcctccatccaccaccaccaccacttcttcccttctcccaccacctatattaataacacttcttctctctccactgacttcacagaccatctctcagtcccaagtgatgacgtggcagagctagagtggctatcgcaattcatggaggactcgttcactgactttccgagcaccattaatattccaaccgacacgtcgtctcgcatcaaatcttgtagcaaacgttcacgaaccaccaccaccgcgacatcctcctcggcagatatcgagactgcggtgaccggggaatcgagagtgaagaaggaaaataacggagcgccacattcttcggcggagacggaaggaggagctcggaggtgcactcactgcgcgtcggagaagacgccgcagtggaggacgggtccgctggggccgaaaacgctatgtaatgcttgtggagtaaggtacaagtcgggtcggctcgtacccgaataccgacccgcagcgagcccgacttttgtgctgactcagcattcgaactcgcaccgtaaagttttggagctccggagacagaaagagatgatgttgaggcagcagcaacagcacggttatcaaggttatgaagtttgc

SEQ ID NO: 164 - protein, 246 aa, Populus trichocarpa
  POPTR_0002s14380.1
MDVYGGVSTSAPDYFLIDDLLDFSNDDLLTSSTDHHHLPPPETSSIHHHHHFFPSPTTYINNTSSLSTDFTDHLSVPSDDVAELEWLSQFMEDSFTDFPSTINIPTDTSSRIKSCSKRSRTTTTATSSSADIETAVTGESRVKKENNGAPHSSAETEGGARRCTHCASEKTPQWRTGPLGPKTLCNACGVRYKSGRLVPEYRPAASPTFVLTQHSNSHRKVLELRRQKEMMLRQQQQHGYQGYEVC

SEQ ID NO: 165 - DNA, 678 bp, Glycine max
  Glyma03g27250.1
atggacttgtacggttccttttccaccccttcagattgcttacacatcgatgattttctagatttctccaacatcaccaccaccaccaccgacacccaccaccactttcctccgccgcaaaactctccatcaatctcccacgatcccaatttcttcctcaatttcccttccgttccgagcgacgaagcagtggagctggagtggctctcccagttcgtgaacgacgaggcgacgtcgtttcacaacatcccaccacccgcatccattggatcccacacgacgccgtttctttccaacaataacaggaacgataataataacgaatatcccaaatcatcatcatcttcaccggtgttggcgggaaaatcgagagcaagaagggaagggtcggtgaccggcgacggcgtgcggcgctgcagccactgtgcgacggataagaccccgcagtggcgcacgggaccgttggggccgaagacgctctgcaacgcgtgcggcgtgcggttcaagtcgggtcggctcgtacccgaataccgacccgccgcgagccctacgttcgtgatgactcagcactcgaactcgcaccgcaaggttatggagctccgtcgccagaaggagctgctccgccaccagcagcaagaacaatgctaccgtcacactcaccacgacttcaaagtctgc

SEQ ID NO: 166 - protein, 226 aa, Glycine max
  Glyma03g27250.1
MDLYGSFSTPSDCLHIDDFLDFSNITTTTTDTHHHFPPPQNSPSISHDPNFFLNFPSVPSDEAVELEWLSQFVNDEATSFHNIPPPASIGSHTTPFLSNNNRNDNNNEYPKSSSSSPVLAGKSRARREGSVTGDGVRRCSHCATDKTPQWRTGPLGPKTLCNACGVRFKSGRLVPEYRPAASPTFVMTQHSNSHRKVMELRRQKELLRHQQQEQCYRHTHHDFKVC

SEQ ID NO: 167 - DNA, 1062 bp, Brachypodium distachyon
  Bradi1g78540.1
atggcgcaggagtgggaggcagccatgggcatggagctcggcatgggaactactcctcactacgcagcgtcaccagctgctgctgctgccgcaaccatggccgcgccattcggccacggcagcgcctactctcactcgctgccacaccattaccacttctacggtggctcgggtgccgaggtggcggacccgatgcgcgtcgacgagatgctcgacctctcttcccacctcggcgcccacgacttcttccccggcggcagcaatggcgccgctcagggcgagcaagctcctcctcctgctgctccttcttcctcggatcatcatggccatggccaccaccactcgtcgtccaactccttcaacctctccttcgccgacgagttcttcgtccccgtgccgcgagaggaagccgcggagctggagtggctgtcgaatttcgtggacgactcgtacccggacacccccaactatccgccggccgtgcaagccgccgccaggaacggcgcccgccaggagatgctccataacaacaacaatcccgcatccacggcgctgcctggccgcggcgcgcggagcaagcggtcgcgcgcggcctcggccgccgccgccgcgtggcacgccctggtgccgcggcatcaggagcaccagaggccgtcgccgtcctcgtcttcgtcttcctccgaccagcagcagctggtgtcttcctcgaagccggcgaggccaaaggcggagctgggcagcgaggagcagggaggcgtgcggcggtgcacgcactgcgcgtcggagaagacgccgcagtggcggacggggccgcttgggcccaagacgctgtgcaacgcgtgcggggtccggtacaagtccggcaggctggtgcccgagtaccggccggcggcgagcccgacgttcgtgctcacgcagcactccaactcccaccgcaaggtcatggagctccgccgccagaacgagcagctcgtccacatccgtggaggcgccgccgctggatcgccgtcgtcgggatcggccgccagcggggagcacatgttccgcgactacggagtctgt

SEQ ID NO: 168 - protein, 354 aa, Brachypodium distachyon
  Bradi1g78540.1
MAQEWEAAMGMELGMGTTPHYAASPAAAAAATMAAPFGHGSAYSHSLPHHYHFYGGSGAEVADPMRVDEMLDLSSHLGAHDFFPGGSNGAAQGEQAPPPAAPSSSDHHGHGHHHSSSNSFNLSFADEFFVPVPREEAAELEWLSNFVDDSYPDTPNYPPAVQAAARNGARQEMLHNNNNPASTALPGRGARSKRSRAASAAAAAWHALVPRHQEHQRPSPSSSSSSSDQQQLVSSSKPARPKAELGSEEQGGVRRCTHCASEKTPQWRTGPLGPKTLCNACGVRYKSGRLVPEYRPAASPTFVLTQHSNSHRKVMELRRQNEQLVHIRGGAAAGSPSSGSAASGEHMFRDYGVC

SEQ ID NO: 169 - DNA, 1119 bp, Zea mays
  GRMZM2G101058_T01
atggcgtcggagtgggaaatggccatgggggtggagctcggcatgggaatgggcggcacgtaccaccacaacgcctccagcatcaccaccgcgccgatgatgatgagcagccatccccacagccacagcggcggcgccgccagctactccacgccgcaccaccaccattactacggcgggatgccgcccatgggcgacgccatgcgcgtcgacgacctcctcgacctctccacccccggcgccggcgcccatgagttcttccccaccgcggcgccggccactgacaaggggcaccactcgtcgggggccatgggtgagccctcacccaccgccaactcgtcggatcaccggacgtcggccctctccttcgccgatgagttctacatacccaccgaggaagctgcggagctggagtggctatccaagttcgtggacgactcctattcggacatgccgaattactcgtccgccacgcatgcggcgatggcggcggcggctgctgctgctgctaacgcggcaggcaacggaggaggcaccacctcggccggtcaagacagcggcgtcgccgcggcgcctggccgcggcgcgcgcagcaggcggtcccgcgcgaccgccgcggctgccgcggtgtggcactccctcgtgccgcgcccgccgtctcagtcgtccccttcatcgtcgtcctgctcgtcctcggacttcccgtcgtcgaacaagccggcgcgcccgaacggcggcagccgcggcaagaaggtcccgggtccccccggcggcgggcccgctggcggggaggcgggcctggagggcggcggcgtgcggcggtgcacgcactgcgcgtcggagaagacgccgcagtggaggacggggccgctgggccccaagaccctctgcaacgcgtgcggcgtgcggttcaagtccgggcggctgatgcccgagtaccggccggcggccagccccaccttcgtgctcacgcagcactccaactcgcaccgcaaggtcatggagctgcgccgccagaaggagctcatcctcatccgcggaagccaccgcgacgccgccgcaggatccgccgccggcgggccgaggccggagctcatgttccgtgactacggcgtgtgt

SEQ ID NO: 170 - protein, 373 aa, Zea mays
  GRMZM2G101058_T01
MASEWEMAMGVELGMGMGGTYHHNASSITTAPMMMSSHPHSHSGGAASYSTPHHHHYYGGMPPMGDAMRVDDLLDLSTPGAGAHEFFPTAAPATDKGHHSSGAMGEPSPTANSSDHRTSALSFADEFYIPTEEAAELEWLSKFVDDSYSDMPNYSSATHAAMAAAAAAAANAAGNGGGTTSAGQDSGVAAAPGRGARSRRSRATAAAAAVWHSLVPRPPSQSSPSSSSCSSSDFPSSNKPARPNGGSRGKKVPGPPGGGPAGGEAGLEGGGVRRCTHCASEKTPQWRTGPLGPKTLCNACGVRFKSGRLMPEYRPAASPTFVLTQHSNSHRKVMELRRQKELILIRGSHRDAAAGSAAGGPRPELMFRDYGVC

SEQ ID NO: 171 - DNA, 1002 bp, Citrus clementina
  clementine0.9_015262m
atggagacaccggaattctacatcggaggttacttcaacgccgcgtcgacgaacaatttctcgtcggagaagcgagtcgtcgtcgcggccgaccaaaaaccaggcgagaacttcaacttcaccgttgaagacctactcgacttctccaacgacgacgccatcatgaacgacggcggatttttcgaaaatgtcgccgctaactccactgattcttccaccgtcacgtccaattccgccgtctccggcggcgaaaacaacttccctgccaatttctccggttgccgtagcagcaacagcttcgctgactcccaattctgcggcgaactatgcgttccgtacgatgacttggcagagttagaatggctttcaaattttgttgaagactcattctcaatggaccaaacattacaaaagagtgaccttgagtttttatccgggtccaaatcactcacacccgaatcctcttcatcatcaacccgactcgaaccggtcagcccaaaagccagcaacccggttttcctccccgagactccgctgcccggtaaagcccggtccaagcgcccacgtgctgcgccttgtgattggtccacacgtctcctccacgtgtccccgaagggaccgtccgtggagcgtgagagtccgaaccccctgatgcatacggagtcgggtgattcagttcgaaaatgtttgcactgtgcgtcagagaagaccccacaatggcggactgggccgatgggtccgaaaactttgtgcaatgcgtgtggagtccgctacaagtccggtcggttggtacccgaataccgacccgctgctagtcccacatttgtgtcagcaaagcattcaaattcacataggaaggtaatggaacttaggaggcagaaagaaatgcaaagggcaccgcagcaacaatttcttggtcaacgttcgattttcggtgtatccaacggtgctgatgattacttgattcatcatcctagcggacctgattttaggcatatgatt

SEQ ID NO: 172 - protein, 334 aa, Citrus clementina
  clementine0.9_015262m
METPEFYIGGYFNAASTNNFSSEKRVVVAADQKPGENFNFTVEDLLDFSNDDAIMNDGGFFENVAANSTDSSTVTSNSAVSGGENNFPANFSGCRSSNSFADSQFCGELCVPYDDLAELEWLSNFVEDSFSMDQTLQKSDLEFLSGSKSLTPESSSSSTRLEPVSPKASNPVFLPETPLPGKARSKRPRAAPCDWSTRLLHVSPKGPSVERESPNPLMHTESGDSVRKCLHCASEKTPQWRTGPMGPKTLCNACGVRYKSGRLVPEYRPAASPTFVSAKHSNSHRKVMELRRQKEMQRAPQQQFLGQRSIFGVSNGADDYLIHHPSGPDFRHMI

SEQ ID NO: 173 - DNA, 876 bp, Arabidopsis thaliana
  AT2G17950.1
atggagccgccacagcatcagcatcatcatcatcaagccgaccaagaaagcggcaacaacaacaacaacaagtccggctctggtggttacacgtgtcgccagaccagcacgaggtggacaccgacgacggagcaaatcaaaatcctcaaagaactttactacaacaatgcaatccggtcaccaacagccgatcagatccagaagatcactgcaaggctgagacagttcggaaagattgagggcaagaacgtcttttactggttccagaaccataaggctcgtgagcgtcagaagaagagattcaacggaacaaacatgaccacaccatcttcatcacccaactcggttatgatggcggctaacgatcattatcatcctctacttcaccatcatcacggtgttcccatgcagagacctgctaattccgtcaacgttaaacttaaccaagaccatcatctctatcatcataacaagccatatcccagcttcaataacgggaatttaaatcatgcaagctcaggtactgaatgtggtgttgttaatgcttctaatggctacatgagtagccatgtctatggatctatggaacaagactgttctatgaattacaacaacgtaggtggaggatgggcaaacatggatcatcattactcatctgcaccttacaacttcttcgatagagcaaagcctctgtttggtctagaaggtcatcaagaagaagaagaatgtggtggcgatgcttatctggaacatcgacgtacgcttcctctcttccctatgcacggtgaagatcacatcaacggtggtagtggtgccatctggaagtatggccaatcggaagttcgcccttgcgcttctcttgagctacgtctgaac

SEQ ID NO: 174 - protein, 292 aa, Arabidopsis thaliana
  AT2G17950.1
MEPPQHQHHHHQADQESGNNNNNKSGSGGYTCRQTSTRWTPTTEQIKILKELYYNNAIRSPTADQIQKITARLRQFGKIEGKNVFYWFQNHKARERQKKRFNGTNMTTPSSSPNSVMMAANDHYHPLLHHHHGVPMQRPANSVNVKLNQDHHLYHHNKPYPSFNNGNLNHASSGTECGVVNASNGYMSSHVYGSMEQDCSMNYNNVGGGWANMDHHYSSAPYNFFDRAKPLFGLEGHQEEEECGGDAYLEHRRTLPLFPMHGEDHINGGSGAIWKYGQSEVRPCASLELRLN

SEQ ID NO: 175 - DNA, 681 bp, Eucalyptus grandis
  Eucgr.J02429.1
atggaaccccaacagcagcagcagcaacagcatcaaaaccaagaggacatgaactgcagcaacaacaacggtgggaaaggtggaggcacgagcagtagcagcagttacgcttgcaggcaaagcagtacgaggtggacgccgacgacggaccagataaggatcctcaaggacctctactacaactacggcgtgcggtcccccaccgccgaccagatccagaggatctccgcccgcctccgccagtacggcaagatcgagggcaagaacgtgttctactggttccagaaccacaaggcccgcgagcgccagaagaagcgcttcttctcccccgacccaaattctaacatcaatggcactgccgctcctccacccacggcctccgtggtcaacccccagacgagaggcggagggcgcggaagtggcggttggagcggtaaactacctcctcctgaagagccctttgtgctccacaacaagttctctaacctcactcctcctgggctttgttcttcttcagctgctgctgctggtgtaatggctgttgggcagatgggtggctacggatacggttctgtgacaatggagaagaactttagggtaagtaaagaagcgttgtttaattggtatggagcgatatttattcttatggaaggtataaatcaaacctatctttgtatgaag

SEQ ID NO: 176 - protein, 227 aa, Eucalyptus grandis
  Eucgr.J02429.1
MEPQQQQQQQHQNQEDMNCSNNNGGKGGGTSSSSSYACRQSSTRWTPTTDQIRILKDLYYNYGVRSPTADQIQRISARLRQYGKIEGKNVFYWFQNHKARERQKKRFFSPDPNSNINGTAAPPPTASVVNPQTRGGGRGSGGWSGKLPPPEEPFVLHNKFSNLTPPGLCSSSAAAAGVMAVGQMGGYGYGSVTMEKNFRVSKEALFNWYGAIFILMEGINQTYLCMK

SEQ ID NO: 177 - DNA, 684 bp, Glycine max
  Glyma01g37190.1
atgatggaacctcaacaacaacaacaacaagcacaagggagccaacaacaacaacaaaacgaggatggtggcagtggaaaaggggggtttctgagcaggcaaagtagtacacggtggactccaacaaacgaccagataagaatattgaaggaactttactacaacaatggaattagatccccgagtgcagagcagattcagaggatctctgctaggctgaggcagtacggtaagattgaaggcaagaatgtcttttattggttccagaaccacaaagctcgagaaaggcagaagaaaaggttcacttctgatcataatcataataatgtccccatgcaaagacccccaactaatccttctgctgcttggaaacctgatctagctgatcccattcacaccaccaagtattgtaacatctcttctactgcagggatctcttcggcatcatcttctgttgagatggttactgtgggacagatggggaattatgggtatggttctgtgcccatggagaaaagttttagggactgctcgatatcagctgggggtagcagtggccatgttggattaataaaccacaacttggggtgggttggtgtggacccatataattcctcaacctatgccaacttctttgacaaaataaggccaagtgatcaagaaacccttgaagaagaagcagag

SEQ ID NO: 178 - protein, 229 aa, Glycine max
  Glyma01g37190.1
MMEPQQQQQQAQGSQQQQQNEDGGSGKGGFLSRQSSTRWTPTNDQIRILKELYYNNGIRSPSAEQIQRISARLRQYGKIEGKNVFYWFQNHKARERQKKRFTSDHNHNNVPMQRPPTNPSAAWKPDLADPIHTTKYCNISSTAGISSASSSVEMVTVGQMGNYGYGSVPMEKSFRDCSISAGGSSGHVGLINHNLGWVGVDPYNSSTYANFFDKIRPSDQETLEEEAEN

SEQ ID NO: 179 - DNA, 414 bp, Glycine max
  Glyma11g08090.1
atggaacctcaacaacaacaagggagccaacaacaacaacaaaacgaggatgcaggtggcagtggaaaaggggggtttctgagcaggcaaagtagtacacggtggactcccacaaacgaccagatacgaatactgaaggacctttactacaacaatggaattagatccccgagtgcagagcagattcagaggatctctgctaggctgaggcagtacggtaagattgaaggcaagaatgtcttttattggttccagaaccacaaagctcgagaaaggcagaagaaaaggttcacttttgatcataataacaataacgtccccatgcaacaaagaccaccaactcatcctaatccttctgcttctgcttggaaacctgatcccattcacaccaagttaaccaaaccaaccatatac

SEQ ID NO: 180 - protein, 138 aa, Glycine max
  Glyma11g08090.1
MEPQQQQGSQQQQQNEDAGGSGKGGFLSRQSSTRWTPTNDQIRILKDLYYNNGIRSPSAEQIQRISARLRQYGKIEGKNVFYWFQNHKARERQKKRFTFDHNNNNVPMQQRPPTHPNPSASAWKPDPIHTKLTKPTIY

SEQ ID NO: 181 - DNA, 840 bp, Vitis vinifera
  GSVIVT01018787001
atggaacctcaacaacagctccagcagcagcagcaacaaaaccaacaacagccaaacgaggatagcggcagcagcaaaggcagttttctgtgcaggcaaagcagtacacgctggactcctacaactgaccagataagaatattgaaggacctttactacaacaatggagttaggtccccaagtgctgaacagattcagaggatctcagctaggctgaggcagtacggcaagatcgaaggcaagaacgtcttttattggtttcagaaccataaagctcgtgaaaggcagaagaagcgattcactactgatatgcccatgcaaagatcccttggaaatgccggttggagacctgatgatcccattcacaacaaatttcataccattcccactcctgggatatcttccccatcttcttcttcttcacccagtgtgcttgctgttgggcagatgggaagctttggatatggatctgtggagaggagttttacagactgttcaatatcagcaggtggtggtcgtggtggggttggtggatctataaaccagagcttcgaatgggttggcatggacccatattcttcatcttatgcactctttgacaagagaaaaacaatgggtgaaagcttcgaagaagagcaagaagaagaagcaactccggagattgaaacgctcccactctttcccatgcacgctgaggatatcactggcttttgcaacattaagcccgaatccgacgcctactactccggctggtacaggcccgccgacgccaagaccagttcccgcacttctcttgagcttagcctcaactcctacgccggcaggtccccggattccccc

SEQ ID NO: 182 - protein, 280 aa, Vitis vinifera
  GSVIVT01018787001
MEPQQQLQQQQQQNQQQPNEDSGSSKGSFLCRQSSTRWTPTTDQIRILKDLYYNNGVRSPSAEQIQRISARLRQYGKIEGKNVFYWFQNHKARERQKKRFTTDMPMQRSLGNAGWRPDDPIHNKFHTIPTPGISSPSSSSSPSVLAVGQMGSFGYGSVERSFTDCSISAGGGRGGVGGSINQSFEWVGMDPYSSSYALFDKRKTMGESFEEEQEEEATPEIETLPLFPMHAEDITGFCNIKPESDAYYSGWYRPADAKTSSRTSLELSLNSYAGRSPDSP

SEQ ID NO: 183 - DNA, 873 bp, Citrus clementina
  clementine0.9_033636m
atggagcctcaacagcagcaaaaccaacaccaaggaaacggggcttgtggcggcagcggcaaagggaacaactgtcactgcaggccaacatgcccacgctggactcccacaactgaccagatacgaatattgaaggaactttactacaataatggcgtaaggtccccaactgccgaacaaattcagaagatctctgctaggcttagacagtacggcaagatcgaaggtaaaaatgtcttttattggtttcagaactacaaagcgcgagagaggctgaaaaagaagatcgaaggcagctccacctctgctgctgataatcttcccatgcaccagagaccagctgctgctactaactggaaacctgaagatttcgctaacaaatcgcggtctcagtctataacctctgctggggtttctgctacacttccttcatattctgtgtatactggtggtcaaatgggagaccatggatatggacctgttaccatggagaagaattttagggactgctcaatatcatcaactggtagcagtgttgttggcggatccagaagccaaaactatggctgggttggtatagacccacacacttcatcatacattttttttggccagaagaactctgcggatggcaaccaaggaaatgacaaagaagacgaagaagatgaagaaaatggtcacccaggtattgaaacgctccctctctttcccatgcatggcgaagacagcatcaacgattattggaacagcaagccaaattcaagcagctactactccggctggtatggttccaatgatggtagcagcacctcttcttcagcttctcttgagctcagcctcaattcctacaccagcggatcctcgggctctata

SEQ ID NO: 184 - protein, 291 aa, Citrus clementina
  clementine0.9_033636m
MEPQQQQNQHQGNGACGGSGKGNNCHCRPTCPRWTPTTDQIRILKELYYNNGVRSPTAEQIQKISARLRQYGKIEGKNVFYWFQNYKARERLKKKIEGSSTSAADNLPMHQRPAAATNWKPEDFANKSRSQSITSAGVSATLPSYSVYTGGQMGDHGYGPVTMEKNFRDCSISSTGSSVVGGSRSQNYGWVGIDPHTSSYIFFGQKNSADGNQGNDKEDEEDEENGHPGIETLPLFPMHGEDSINDYWNSKPNSSSYYSGWYGSNDGSSTSSSASLELSLNSYTSGSSGSI

SEQ ID NO: 185 - DNA, 816 bp, Solanum lycopersicum
  Solyc02g083950.2.1
atggaacatcaacacaacatagaagatggtggtaaaaatagtaacaacagtttcctgtgcaggcaaagtagtagccgttggacgccaacgagcgatcagataagaatattgaaggatctctactacaacaatggagttaggtctccaactgctgaacagattcagaggatatctgctaagttgagacagtacggtaagattgaaggcaaaaatgtgttttattggtttcagaaccataaagctcgtgaaagacaaaagaagaggctcattgctgctgcctctgccactgataataataatatctcttccatgcaaatgattccacatctttggagatctcctgatgatcaccacaagtacaacactactactactaatccaggtgttcagtgtccatcaccatcttcacatggggtattaccagtggtacagactggaaactatggttatggaactttggctatggagaagagctttagggagtgttcaatatcaccaccaggtggtagttatcatcaaaatttgacatgggttggtgttgatccttacaacaatatgagtactacttctccagcaacttacccttttcttgaaaaaagcaacaacaaacactatgaagaaaccctagatgaagagcaagaagaagaaaattaccaaaggggtaactctgctttagaaactctgtcacttttccccatgcatgaagagaacatcatctcaaatttctgcatcaaacatcatgaatcttctggaggatggtaccattctgataataacaatttggctgctcttgaacttactctcaactctttcccc

SEQ ID NO: 186 - protein, 272 aa, Solanum lycopersicum
  Solyc02g083950.2.1
MEHQHNIEDGGKNSNNSFLCRQSSSRWTPTSDQIRILKDLYYNNGVRSPTAEQIQRISAKLRQYGKIEGKNVFYWFQNHKARERQKKRLIAAASATDNNNISSMQMIPHLWRSPDDHHKYNTTTTNPGVQCPSPSSHGVLPVVQTGNYGYGTLAMEKSFRECSISPPGGSYHQNLTWVGVDPYNNMSTTSPATYPFLEKSNNKHYEETLDEEQEEENYQRGNSALETLSLFPMHEENIISNFCIKHHESSGGWYHSDNNNLAALELTLNSFP

SEQ ID NO: 187 - DNA, 867 bp, Oryza sativa
  LOC_Os04g56780.1
atggatcacatgcagcagcagcagcggcagcaggtgggtggagggggaggagaggaggtggcggggaggggtggtgtgccggtgtgccggccgagcgggacgaggtggacgccgacgacggagcagatcaagatcctgcgggagctgtactacagctgcggcatcaggtcgcccaactcggagcagatccagcggatcgccgccatgctgcgccagtacggccgcatcgagggcaagaacgtcttctactggttccagaaccacaaggcccgcgagcgccagaagaagcgcctcaccacgctcgacgtcaccaccaccaccgccgccgccgccgacgccgacgccagccacctcgccgtcctctccctctcgcctacagcagctggcgcgacggctccctctttcccgggcttctacgtcggcaatggcggcgccgtgcagacggatcaggccaacgtcgtcaactgggactgcaccgccatggcagccgagaaaaccttcctgcaggactacatgggcgtgagcggcgtcggttgcgccgccggggcggccccgacgccgtgggcgatgacgacgacgactcgcgagcccgagacgcttccactcttcccagtcgtcttcgtcggcggcgacggcgcgcatcgtcacgccgtccacggcggtttcccgtccaacttccagcgctggggttctgctgctgctacctccaacaccattacggtccagcagcatttgcagcagcacaacttttacagcagcagcagcagccagctgcacagccaggatgggccggcagcaggcacatccctggagctcactctcagctcctactactgctcatgctcaccttaccctgcagggtccatg

SEQ ID NO: 188 - protein, 289 aa, Oryza sativa
  LOC_Os04g56780.1
MDHMQQQQRQQVGGGGGEEVAGRGGVPVCRPSGTRWTPTTEQIKILRELYYSCGIRSPNSEQIQRIAAMLRQYGRIEGKNVFYWFQNHKARERQKKRLTTLDVTTTTAAAADADASHLAVLSLSPTAAGATAPSFPGFYVGNGGAVQTDQANVVNWDCTAMAAEKTFLQDYMGVSGVGCAAGAAPTPWAMTTTTREPETLPLFPVVFVGGDGAHRHAVHGGFPSNFQRWGSAAATSNTITVQQHLQQHNFYSSSSSQLHSQDGPAAGTSLELTLSSYYCSCSPYPAGSM

SEQ ID NO: 189 - DNA, 792 bp, Populus trichocarpa
  POPTR_0005s11680.1
atggaacctcaacaacaacaacaccaaaaccaacaacaaccaaatgaggataataatggtggtgccaaaggaaactttatttgcaggcaaaccagtacaaggtggactcccactactgaccagataagaatattgaaggaactgtactacatcaaaggtgttaggtccccaaatggagctgagattcagcagatctctgctaggcttagaaagtacggcaagattgaaggcaagaatgtcttttattggtttcagaaccataaagctcgtgagaggcagaagaaaaggttcaccaatgatgtccccacgcaacaaagaactaccttgaaacctgaagattattactcttacaagtactccggtagcaataataatcctgggttttcttctgcttcttcatcttcaaatactggtgcggttactgttgggcaagcagataactatggatatggatctgtaaccatgcaagagaaaaaaaattgggactgttcagtaccagctggtggtgaatccatgaacaacattaactatggatcacggggtggcatatatccttacagttcttcctatactgtatttgatcaagaccaggaagccgctgaaaagattgagactcttcctctatttcccatgcatggcgaggacatcagtacctctttcaacatcaacaacgttaacccagacttttattacagtagctggtatggctctgatgattatggcaatgccactacttctcgtacttccttggagcttagcctctactcctacaatggccagcaacaagattat

SEQ ID NO: 190 - protein, 264 aa, Populus trichocarpa
  POPTR_0005s11680.1
MEPQQQQHQNQQQPNEDNNGGAKGNFICRQTSTRWTPTTDQIRILKELYYIKGVRSPNGAEIQQISARLRKYGKIEGKNVFYWFQNHKARERQKKRFTNDVPTQQRTTLKPEDYYSYKYSGSNNNPGFSSASSSSNTGAVTVGQADNYGYGSVTMQEKKNWDCSVPAGGESMNNINYGSRGGIYPYSSSYTVFDQDQEAAEKIETLPLFPMHGEDISTSFNINNVNPDFYYSSWYGSDDYGNATTSRTSLELSLYSYNGQQQDY

SEQ ID NO: 191 - DNA, 774 bp, Populus trichocarpa
  POPTR_0005s11680.2
atggaacctcaacaacaacaacaccaaaaccaacaacaaccaaatgaggataataatggtggtgccaaaggaaactttatttgcaggcaaaccagtacaaggtggactcccactactgaccagataagaatattgaaggaactgtactacatcaaaggtgttaggtccccaaatggagctgagattcagcagatctctgctaggcttagaaagtacggcaagattgaaggcaagaatgtcttttattggtttcagaaccataaagctcgtgagaggcagaagaaaaggttcaccaatgatgtccccacgcaacaaagaactaccttgaaacctgaagattattactcttacaagtactccgggttttcttctgcttcttcatcttcaaatactggtgcggttactgttgggcaagcagataactatggatatggatctgtaaccatgcaagagaaaaaaaattgggactgttcagtaccagctggtggtgaatccatgaacaacattaactatggatcacggggtggcatatatccttacagttcttcctatactgtatttgatcaagaccaggaagccgctgaaaagattgagactcttcctctatttcccatgcatggcgaggacatcagtacctctttcaacatcaacaacgttaacccagacttttattacagtagctggtatggctctgatgattatggcaatgccactacttctcgtacttccttggagcttagcctctactcctacaatggccagcaacaagattat

SEQ ID NO: 192 - protein, 258 aa, Populus trichocarpa
  POPTR_0005s11680.2
MEPQQQQHQNQQQPNEDNNGGAKGNFICRQTSTRWTPTTDQIRILKELYYIKGVRSPNGAEIQQISARLRKYGKIEGKNVFYWFQNHKARERQKKRFTNDVPTQQRTTLKPEDYYSYKYSGFSSASSSSNTGAVTVGQADNYGYGSVTMQEKKNWDCSVPAGGESMNNINYGSRGGIYPYSSSYTVFDQDQEAAEKIETLPLFPMHGEDISTSFNINNVNPDFYYSSWYGSDDYGNATTSRTSLELSLYSYNGQQQDY

SEQ ID NO: 193 - DNA, 975 bp, Setaria italica
  Si024219m
atggcggccaatgtgggcggaaagagtgttgtcggcggcggtgctggggcgggaggcactaccggcggcggcgcggcggcgtgccgcgccagcgggtcgcggtggacgccgacgccggagcagatcaggatcctcaaggagctctactacgggtgcggcatccggtcgcccaactcggagcagatccagcgcatcaccgccatgctgcgccagcacggcaagatcgagggcaagaacgtcttctactggttccagaaccacaaggcccgcgagcgccagaagcgccgcctcaccaacctcgacgtcaacgtccccgctgccgccgcggccgacgtcggccacctcggcgtgctctcgctctcgtcgccttcaggcgcggcgcctccctcctccccgttgggcttgtaccccggcaatggcggcgcgtcggcgttgcagctggacacgagctccgattggggcagcaccaccgccgtggccaccgagacatgcttcctgcaggactacatgggcgtgatgaggagcaccgccggccaccacgacagcagcgccggcggcgccgcggcctcgccgtgggcatgtttctcgtcgccggactcgtgggcggcggcaccggcgatgacgcgggcgcccgagacgctccctctcttcccgactggcgacaacgtccagcccccgcggccgcggcgcggagcaccagcaggcgacgccatccgcggcggcggcggcggtagcggctacctccccaccctgccgttctggggtgccgctgccacggctgccaccgccaccaccaccaccacttccgttacgatccagcagcaacaccaccagctgctgcagctgcaagaccagtacagcttttacaccaccaacagccagccgcccagcagccatgacgcatcatcagcggctactgcatccctggagctgagcctgagctcctggtgctccccttaccctgcagggaccatg

SEQ ID NO: 194 - protein, 325 aa, Setaria italica
  Si024219m
MAANVGGKSVVGGGAGAGGTTGGGAAACRASGSRWTPTPEQIRILKELYYGCGIRSPNSEQIQRITAMLRQHGKIEGKNVFYWFQNHKARERQKRRLTNLDVNVPAAAAADVGHLGVLSLSSPSGAAPPSSPLGLYPGNGGASALQLDTSSDWGSTTAVATETCFLQDYMGVMRSTAGHHDSSAGGAAASPWACFSSPDSWAAAPAMTRAPETLPLFPTGDNVQPPRPRRGAPAGDAIRGGGGGSGYLPTLPFWGAAATAATATTTTTSVTIQQQHHQLLQLQDQYSFYTTNSQPPSSHDASSAATASLELSLSSWCSPYPAGTM

SEQ ID NO: 195 - DNA, 960 bp, Zea mays
  GRMZM2G047448_T01
atggcggccaacgtgggcgcgggcaggagtgctggcggcggcggagccggcactggcactggcactgctgctggcagcggcggcgtgtcgacggccgtgtgccgccctagcggctcgcggtggacgccgacgccggagcagatcaggatcctcaaggagctctactacggctgcggcatccggtcgcccaactcggagcagatccagcgcatcaccgccatgctgcggcagcacggcaagatcgagggcaagaacgtcttctactggttccagaaccacaaggcccgcgagcgccagaagcgccgcctcaccaacctcgacgtcaacgtgcccgtcgccgccgacgacagcgcccaccgccttggcgtcctctcgttgtcgccttcttcaggttgttcaggcgcggcgcctccgtcgcccaccctcggcttctacgccggcggcaatggctccgctgtgatgctggacacgagttccgattggggcagcgctgctgccatggccactgaggcatgcttcatgcaggactacatgggcgtgatgggcggcgcgtcaccgtgggcatgctcctcctcgtcgtcggaggacccgatggcggcgctggcgctggcgccgaaggtgacccgggcgcccgagacgctccctctcttcccgaccggcggcggcggagacgataggcagcccccgcggccgcggcagtctgtcccagcaggcgaggccatccgcggcggcagcagcagcagcagctaccttccgttctggggtgccgcgcccaccccaactggcagtgccacttccgttgcgatccagcagcaacaccagctgatgcagatgcaagagcagtacagcttttacagcaacgcccagctgctgcccggcaccggcagccaggatgcagcagcaacatccctggagctgagcctcagctcctggtgctccccttaccctgcagggaccatg

SEQ ID NO: 196 - protein, 320 aa, Zea mays
  GRMZM2G047448_T01
MAANVGAGRSAGGGGAGTGTGTAAGSGGVSTAVCRPSGSRWTPTPEQIRILKELYYGCGIRSPNSEQIQRITAMLRQHGKIEGKNVFYWFQNHKARERQKRRLTNLDVNVPVAADDSAHRLGVLSLSPSSGCSGAAPPSPTLGFYAGGNGSAVMLDTSSDWGSAAAMATEACFMQDYMGVMGGASPWACSSSSSEDPMAALALAPKVTRAPETLPLFPTGGGGDDRQPPRPRQSVPAGEAIRGGSSSSSYLPFWGAAPTPTGSATSVAIQQQHQLMQMQEQYSFYSNAQLLPGTGSQDAAATSLELSLSSWCSPYPAGTM

SEQ ID NO: 197 - DNA, 792 bp, Populus trichocarpa
  POPTR_0007s14130.1
atggaacctcaccaacaacaaccaaatgaggataataacggtggcgccaaagggaactttctttgcaggcaaaccagtacaaggtggaatcccactactgaccagataagaatattgaaggaactgtactacatcaaaggtgttaggtccccaaatggagctgagattcagcagatctctgctaggcttagaaagtacggcaagattgaaggcaagaatgtattttattggtttcagaaccataaagctcgtgagaggcaaaagaaaagactcaccaatgaagtccccatgcaacaaagaactgcctggaaacctgaagattattactcttacaagtactccaacagtaataataatcctgggttttcttcggcttcttcatctgcaaataccggtgtggttactgttgggcagacagatagccatggatatggatcggtaaccatgcaggagaagaattcttgggactgttcagcaccagctggtggtagcaatggtgctggtagtggatccatgagcaatattaactatggatcaggggttgacattaactctcacagttcatcctatgctgtatttggtcaagaacaagaagcagctgcaaagattgagactcttcctctatttccaatgcttggtgaggacatcagtagctctttcaacatcaacaatatcaacccagacttttattacagtagcggctgtggctatggtgattatggcaatgacacttcttcccgtacttccctggaccttagtctctactcctacaatggccaaccacaagattat

SEQ ID NO: 198 - protein, 264 aa, Populus trichocarpa
  POPTR_0007s14130.1
MEPHQQQPNEDNNGGAKGNFLCRQTSTRWNPTTDQIRILKELYYIKGVRSPNGAEIQQISARLRKYGKIEGKNVFYWFQNHKARERQKKRLTNEVPMQQRTAWKPEDYYSYKYSNSNNNPGFSSASSSANTGVVTVGQTDSHGYGSVTMQEKNSWDCSAPAGGSNGAGSGSMSNINYGSGVDINSHSSSYAVFGQEQEAAAKIETLPLFPMLGEDISSSFNINNINPDFYYSSGCGYGDYGNDTSSRTSLDLSLYSYNGQPQDY

SEQ ID NO: 199 - DNA, 777 bp, Populus trichocarpa
  POPTR_0007s14130.2
atggaacctcaccaacaacaaccaaatgaggataataacggtggcgccaaagggaactttctttgcaggcaaaccagtacaaggtggaatcccactactgaccagataagaatattgaaggaactgtactacatcaaaggtgttaggtccccaaatggagctgagattcagcagatctctgctaggcttagaaagtacggcaagattgaaggcaagaatgtattttattggtttcagaaccataaagctcgtgagaggcaaaagaaaagactcaccaatgaagtccccatgcaacaaagaactgcctggaaacctgaagattattactcttacaagtactccaacaggttttcttcggcttcttcatctgcaaataccggtgtggttactgttgggcagacagatagccatggatatggatcggtaaccatgcaggagaagaattcttgggactgttcagcaccagctggtggtagcaatggtgctggtagtggatccatgagcaatattaactatggatcaggggttgacattaactctcacagttcatcctatgctgtatttggtcaagaacaagaagcagctgcaaagattgagactcttcctctatttccaatgcttggtgaggacatcagtagctctttcaacatcaacaatatcaacccagacttttattacagtagcggctgtggctatggtgattatggcaatgacacttcttcccgtacttccctggaccttagtctctactcctacaatggccaaccacaagattat

SEQ ID NO: 200 - protein, 259 aa, Populus trichocarpa
  POPTR_0007s14130.2
MEPHQQQPNEDNNGGAKGNFLCRQTSTRWNPTTDQIRILKELYYIKGVRSPNGAEIQQISARLRKYGKIEGKNVFYWFQNHKARERQKKRLTNEVPMQQRTAWKPEDYYSYKYSNRFSSASSSANTGVVTVGQTDSHGYGSVTMQEKNSWDCSAPAGGSNGAGSGSMSNINYGSGVDINSHSSSYAVFGQEQEAAAKIETLPLFPMLGEDISSSFNINNINPDFYYSSGCGYGDYGNDTSSRTSLDLSLYSYNGQPQDY

SEQ ID NO: 201 - DNA, 975 bp, Zea mays
  GRMZM2G028622_T01
atggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccttcaggcgcggcgcctccctcgcccaccctcggcttctacgccgccggcaatggcggcggatcggctgggctgctggacacgagttccgactggggcagcagcggcgctgccatggccaccgagacatgcttcctgcaggactacatgggcgtgacggacacgggcagctcgtcgcagtggccatgcttctcgtcgtcggacacgataatggcggcggcggcggccgcggcgcgggtggcgacgacgcgggcgcccgagacactccctctcttcccgacctgcggcgacgacgacgacgacgacagccagcccccgccgcggccgcggcacgcagtcccagtcccggcaggcgagaccatccgcggcggcggcggcagcagcagcagctacttgccgttctggggtgccggtgccgcgtccacaactgccggcgccacttcttccgttgcgatccagcagcaacaccagctgcaggagcagtacagcttttacagcaacagcacccagctggccggcaccggcagccaagacgtatcggcttcagcggccgccctggagctgagcctcagctcatggtgctccccttaccctgctgcagggagcatg

SEQ ID NO: 202 - protein, 325 aa, Zea mays
  GRMZM2G028622_T01
MAANAGGGGAGGGSGSGSVAAPAVCRPSGSRWTPTPEQIRMLKELYYGCGIRSPSSEQIQRITAMLRQHGKIEGKNVFYWFQNHKARERQKRRLTSLDVNVPAAGAADATTSQLGVLSLSSPPSGAAPPSPTLGFYAAGNGGGSAGLLDTSSDWGSSGAAMATETCFLQDYMGVTDTGSSSQWPCFSSSDTIMAAAAAAARVATTRAPETLPLFPTCGDDDDDDSQPPPRPRHAVPVPAGETIRGGGGSSSSYLPFWGAGAASTTAGATSSVAIQQQHQLQEQYSFYSNSTQLAGTGSQDVSASAAALELSLSSWCSPYPAAGSM

SEQ ID NO: 203 - DNA, 876 bp, Arabidopsis thaliana
  AT4G28140.1
atggactttgacgaggagctaaatctttgtattacgaaaggtaaaaatgttgatcattcttttggaggagaagcttcttccacgtccccaagatctatgaagaaaatgaagagtcctagtcgtcctaaaccctatttccaatcctcttcttctccttattcgttagaggctttccctttttctctcgatccaacacttcagaatcagcaacaacaactcggatcatacgttccggtacttgagcaacgacaagacccgacaatgcaaggccagaagcaaatgatctcctttagtcctcaacaacaacaacagcagcagcagtatatggcccagtactggagtgacacattgaatctgagtccaagaggaagaatgatgatgatgatgagccaagaagctgttcaaccttacatcgcaacgaagctgtacagaggagtgagacaacgtcaatggggaaaatgggtcgcagagatccgtaagccacgaagcagggcacgtctttggcttggtacctttgatacagctgaagaagctgccatggcctacgaccgccaagccttcaaattacgaggccacagcgcaacactgaatttcccggagcattttgtgaataaggaaagcgagctgcatgattcaaactcgtcggatcagaaagaacctgaaacgccacagccaagcgaggttaacttggagagcaaggaactaccggtgattgatgttgggagagaggaaggtatggctgaggcatggtacaatgccattacatcgggatggggtcctgaaagtcctctttgggatgatttggatagttctcatcagttttcatcagaaagctcatcttcttctcctctctcttgtcctatgaggcctttcttt

SEQ ID NO: 204 - protein, 292 aa, Arabidopsis thaliana
  AT4G28140.1
MDFDEELNLCITKGKNVDHSFGGEASSTSPRSMKKMKSPSRPKPYFQSSSSPYSLEAFPFSLDPTLQNQQQQLGSYVPVLEQRQDPTMQGQKQMISFSPQQQQQQQQYMAQYWSDTLNLSPRGRMMMMMSQEAVQPYIATKLYRGVRQRQWGKWVAEIRKPRSRARLWLGTFDTAEEAAMAYDRQAFKLRGHSATLNFPEHFVNKESELHDSNSSDQKEPETPQPSEVNLESKELPVIDVGREEGMAEAWYNAITSGWGPESPLWDDLDSSHQFSSESSSSSPLSCPMRPFF

SEQ ID NO: 205 - DNA, 1008 bp, Arabidopsis thaliana
  AT2G20880.1
atggctactgctaagaacaagggaaaatcaatcagggtccttggtaccagtgaagcagagaaaaaggatgagatggagttggaggaggagttccagtttagtagcggcaagtataaagattcgggtcctggctcggacatgtggttaggagatgcttcctctacgtctccaagaagtcttaggaagactagaacctttgaccgacataatccctatctcgtatcttcttatgctactcctcagccgccaacaacaactacatgctctgtctcttttcccttttacctccctccagcgattcaaaatcaacaacgatttttacacccgaatgacccttcaggacaaagacagcaacaaatgatctcgtttgatcctcaacaacaggtgcaaccatatgttgcacaacagcagcaacaacaacaacatctattgcagtactggagagacattctgaagctgagtccgagcggaagaatgatgatgatgaacatgttaagacaagaaagcgatctgccactgacgaggccaccggttcaacccttcagcgccaccaagctatatagaggtgtcaggcaacgccactggggaaaatgggttgccgagatccgtaagccacgaaacaggacacgtctctggctagggacattcgatacagcagaagaagccgccatggcctacgaccgcgaggccttcaagttgaggggagagaccgctaggctcaatttccctgaactttttctcaataaacaagagccaactcccgtgcatcagaaacaatgtgagacggggactactagtgaagactcaagcagaagaggagaggatgattcgagcacggcattggcagtaggaggggtgagtgaggagacgggttgggctgaggcatggttcaatgcaattccagaggaatggggacctggaagccctctatgggatgattaccactttcccatttctaaccataaggacgatcttgacgccacacaaaactcttcttctgatacaatt

SEQ ID NO: 206 - protein, 336 aa, Arabidopsis thaliana
  AT2G20880.1
MATAKNKGKSIRVLGTSEAEKKDEMELEEEFQFSSGKYKDSGPGSDMWLGDASSTSPRSLRKTRTFDRHNPYLVSSYATPQPPTTTTCSVSFPFYLPPAIQNQQRFLHPNDPSGQRQQQMISFDPQQQVQPYVAQQQQQQQHLLQYWRDILKLSPSGRMMMMNMLRQESDLPLTRPPVQPFSATKLYRGVRQRHWGKWVAEIRKPRNRTRLWLGTFDTAEEAAMAYDREAFKLRGETARLNFPELFLNKQEPTPVHQKQCETGTTSEDSSRRGEDDSSTALAVGGVSEETGWAEAWFNAIPEEWGPGSPLWDDYHFPISNHKDDLDATQNSSSDTI

SEQ ID NO: 207 - DNA, 1170 bp, Solanum lycopersicum
  Solyc07g054220.1.1
atggcgacaccaccagaggaaccaatggagtttgatgataatacttttgaaagacaacaaaggaggccagtttttgaagaagcttccatgtctaataggcgtttcaaaaaaatcaaaagtccagaacgtcaatcctctgttcaacaaccgtttgatcatcgtaataatccgacgccaatggcgtttcctccacctccgtcatcgtcaaggcttgttttcccttttgcctttgacggtacgcagcagtccatggaaagttcgtcaccattgggagcgaacgcgatgcctctgtttcatccacagcagcaaaatcagcagcaaatgatatctttttcgcctcaacagtgtctttaccctccgtattttgcaggggagttagggccatcgcagaatcagcagcagatgttgaggtattggaatgagacgcttaatttaagtccgagaggaagaatgatgatgatgagcagattggggcaggataacaggggatattttaggcctcaacaggtgcaagtacagccaatttccgctacgaagctatacagaggagtgaggcagagacattgggggaaatgggtagctgaaattcgtcttcctcgtaataggactcgtctttggcttggtacttttgatacagctgaagatgcagctatggcttatgaccgcgaggcgtataagctaagaggagacaatgctaagctcaatttccccgaacactttattggtaaagacagaggagagacatctacagaggctaattcgtcttcaattactactcatgaatcttccttgcctgaacacaattctgaaagtttacaattacagactgtaaataacgaacaactgcctccgtcaccgcccccacagccaccaccagaaggtgataaccatgacgaggactcggggataggatcgagtcaggtgactactaattcacaatcatctgagttagtatggggtgatatggcggaggcttggttcaatgcaactggttggggtccaggtagcccagtttgggatgatttagacacaaataacaacctcatgttttcacctaatcttcattttgggaatttcagtcaacaagagcctcatgattctgatcctcatcaacatcatgacacgaatagcgatccatcttcgccttcatgtcctatgaggccgttcttt

SEQ ID NO: 208 - protein, 390 aa, Solanum lycopersicum
  Solyc07g054220.1.1
MATPPEEPMEFDDNTFERQQRRPVFEEASMSNRRFKKIKSPERQSSVQQPFDHRNNPTPMAFPPPPSSSRLVFPFAFDGTQQSMESSSPLGANAMPLFHPQQQNQQQMISFSPQQCLYPPYFAGELGPSQNQQQMLRYWNETLNLSPRGRMMMMSRLGQDNRGYFRPQQVQVQPISATKLYRGVRQRHWGKWVAEIRLPRNRTRLWLGTFDTAEDAAMAYDREAYKLRGDNAKLNFPEHFIGKDRGETSTEANSSSITTHESSLPEHNSESLQLQTVNNEQLPPSPPPQPPPEGDNHDEDSGIGSSQVTTNSQSSELVWGDMAEAWFNATGWGPGSPVWDDLDTNNNLMFSPNLHFGNFSQQEPHDSDPHQHHDTNSDPSSPSCPMRPFF

SEQ ID NO: 209 - DNA, 1065 bp, Glycine max
  Glyma06g45010.1
atggctaacaatagggaaaagtctaccaaggagggtgttgaagagactcatcatcacaaggtgattggtgaaagtgaaggccaagattgggagattgagaaaggaaagggtcttgatttgagctcagggaggagacaatggaagccagtttttgatgatgcttccctgtcacacaggcctctcaagaaaatccgaagccccgaacgcgaaaacccgaatcaacaacaacaacaaccaccatcctctatgctgtctcttcagcctccttcatcaagaatagtgtttccttttgcttttgaaggctctcaacatccaatgccattcccacacccttttggaaccacaaacttgcctctttttcgtccaaatcttcatccaactcaacaaatgatatcttttgggtcccaacagaacatggggtatccaccattcctagccccagaatctaccatgccacaccaacaccaacaacaccttcaacaacatcatcaacagcttcttcattattggagtgatgcaataaatttgagtccaagagggaggatgatgatgatgatgaataggactgaaggaagacaaatgttaaggccacaagcacagcctctgaatgctaccaagctctatagaggagtgaggcaacgccattggggcaaatgggtagccgagattcgtctccctcgcaatcgaactcgcctttggcttggaacctttgacactgctgaagatgctgctatggcttatgatcgcgaagcctttaagcttagaggggaaaatgctaagctcaatttccctgaactctttctcaacaaagataaagcagaacaatccacaactgttgctcctgcttcttcttctaatgaaggttcaacatcaacatcaagccagaacacaaagcaaccagaaccaataccagaagagattaacactgagacagaagagaatgctgaaactggaaaaggaatttcacaacctcaggaattggtttggggtgaatggttcaatgcaattcctgcaggttggggtcctggaagtcctcttccccacgttcacatatcaggacaaaag

SEQ ID NO: 210 - protein, 355 aa, Glycine max
  Glyma06g45010.1
MANNREKSTKEGVEETHHHKVIGESEGQDWEIEKGKGLDLSSGRRQWKPVFDDASLSHRPLKKIRSPERENPNQQQQQPPSSMLSLQPPSSRIVFPFAFEGSQHPMPFPHPFGTTNLPLFRPNLHPTQQMISFGSQQNMGYPPFLAPESTMPHQHQQHLQQHHQQLLHYWSDAINLSPRGRMMMMMNRTEGRQMLRPQAQPLNATKLYRGVRQRHWGKWVAEIRLPRNRTRLWLGTFDTAEDAAMAYDREAFKLRGENAKLNFPELFLNKDKAEQSTTVAPASSSNEGSTSTSSQNTKQPEPIPEEINTETEENAETGKGISQPQELVWGEWFNAIPAGWGPGSPLPHVHISGQK

SEQ ID NO: 211 - DNA, 927 bp, Glycine max
  Glyma12g12270.1
gaagggactcaactcaaggtgattggtgaaagtgaaggccaagattgggagaaagagaagggaaagcgtcttgatttgagctcagggaggagacaatggaagccagtttttgatgatgcttccgtgtcacataggcctctcaagaaaatccgcagccccgaacccgaaaacccgaatcaacaacaacaacaacagccatcctctatgctgtctcttcaacctccttcatcaagaatagtgtttccttttgcttttgaaggctctcaacatccaatgccattcccacacccttttggaaccacaaacttgcctctttttcgtccacctcttcatccaactcaacaaatgatatcttttttgccctcacagaacatggggtatccaccattcctagccccagaatccaccatgccacacgaacaccaacaacaccatcatcaacagcttcttcagtattggagtgatgcactgaatttgagtccaagagggaggatgatgatgatgaataggactgaagggagacaaatgttaaggccccaagcacagcctttgaatgctaccaagctctataggggagtgaggcaacgccattggggcaaatgggtcgctgagattcgtcttcctcgcaatcgaactcgcctttggcttggaacctttgacactgctgaagatgctgctatggcttatgatcgagaggcctttaagcttagaggggaaaatgcaaagctcaatttccctgaactctttctcaacaaggataaagcagaacaatccacaactgctcctgcatcttcttctaatgaagaagggacgactaacactgagagtgaggacatgccaccaacagagacatttgcagtagaaaacgctgaattggtttggggtgaatggttcaatgcaattcctgcaggttggggacctggaagt

SEQ ID NO: 212 - protein, 310 aa, Glycine max
  Glyma12g12270.1
EGTQLKVIGESEGQDWEKEKGKRLDLSSGRRQWKPVFDDASVSHRPLKKIRSPEPENPNQQQQQQPSSMLSLQPPSSRIVFPFAFEGSQHPMPFPHPFGTTNLPLFRPPLHPTQQMISFLPSQNMGYPPFLAPESTMPHEHQQHHHQQLLQYWSDALNLSPRGRMMMMNRTEGRQMLRPQAQPLNATKLYRGVRQRHWGKWVAEIRLPRNRTRLWLGTFDTAEDAAMAYDREAFKLRGENAKLNFPELFLNKDKAEQSTTAPASSSNEEGTTNTESEDMPPTETFAVENAELVWGEWFNAIPAGWGPGSP

SEQ ID NO: 213 - DNA, 1218 bp, Glycine max
  Glyma12g33020.1
atggctgcagcgaacagtggcaaattcgatgtgggagatgaaactcacaagaattcacgaaagggtagtgaaagccaagattgggagattgagaagggaaagtgcgtggattgttcaagctctcagaggcgtcaatggaagccagtttttgatgacgtttccatctcatacaatagacccttcaagaaaatccgaagccccgatcgccaaaacacaaaccaatcttcttcttcctcttcttcttcttcttcttcttcttctattccttttcaaccttcacctctctctaatcctccttcaagaatagtgttcccttttgcctttgatggttcccaacagcaccccatgcaattccctcaccaatttggaaccacaaacccacctttccctcacccttctctccaaaaccagcaacaccagatgatatcatttggtgattcttcttcacttctacatcaacatcatcatcatcaacagcagcatcagcagcaccagcagcaacttcttcagtattggagtgacgcgttgaatctaagtccaagaggaatgttaacaagattgggaccagatggaaggccattgtttaggcttccaacacagcccataaacacaacaaaactctatagaggagtgaggcaacgccattgggggaaatgggtcgctgaaatccgtcttccacgaaacagaacgcgtctctggctaggcacatttgacacggccgaagacgccgccatggcctacgaccgagaagccttcaagctacgaggagagaatgctagactcaatttcccagaattgttcctcaacaaggacaaaaaagaagaacaacaacaacaagaacaagaagcttcttcgccagttctttcagctattgcaaagcagcatgaaccttctagtgaacaccgtgacgtccccatagaagagtctaatgagaatgattcgggtgacgccacggtgagcgatgaccaggttcatgctactactgagagttccgaaggagtttctcaggaaatggtttggggagaaatgtctgcatggttcaatgctattcctgctgcttggggtcctggtagtcccatgtgggatgatttggatgccaccaataatcttctttgccaatcacacattcctttttccaatcccaatcaacaagaactcaatgatgctgagagacaagaacaaaacactggaccaggttacttgtggaaggatcaggat

SEQ ID NO: 214 - protein, 406 aa, Glycine max
  Glyma12g33020.1
MAAANSGKFDVGDETHKNSRKGSESQDWEIEKGKCVDCSSSQRRQWKPVFDDVSISYNRPFKKIRSPDRQNTNQSSSSSSSSSSSSSIPFQPSPLSNPPSRIVFPFAFDGSQQHPMQFPHQFGTTNPPFPHPSLQNQQHQMISFGDSSSLLHQHHHHQQQHQQHQQQLLQYWSDALNLSPRGMLTRLGPDGRPLFRLPTQPINTTKLYRGVRQRHWGKWVAEIRLPRNRTRLWLGTFDTAEDAAMAYDREAFKLRGENARLNFPELFLNKDKKEEQQQQEQEASSPVLSAIAKQHEPSSEHRDVPIEESNENDSGDATVSDDQVHATTESSEGVSQEMVWGEMSAWFNAIPAAWGPGSPMWDDLDATNNLLCQSHIPFSNPNQQELNDAERQEQNTGPGYLWKDQD

SEQ ID NO: 215 - DNA, 1335 bp, Zea mays
  GRMZM2G300924_T01
atggagccggtgggcggggacggcggtggcggccgcggccgcggccgcgggaggagctggaaggggaagggcgtgagctcgggctccgccgcggggaggcagctggcgccagttttagaagacgcgccggcggccgcattgctccggcccctgaagaagatccgcagcccggaccgccgcctcaaccgctccctgtcctcgctctcgccggctcctccttcccctgactcgtcctctgctttcaaccccacgccgctgccatcggcccgacaaatatttcttgctccggaggcgtcgacagccggatcgccacggctcctgccgctactgcagtactccagcgagttccagcgccctatgacgccgccgccgccggatcagcagcagctccagcagatgatctcgttcggaagcagccagcagccgcgccaagagttcgtggcggcggcggcggcgactcctctgttcccgccgcagctcgtggcgccggaggtgcagcagcaaatgctgctgcgctactggagcgaggcgctgaacctgagcccccgcgggttccgcggcggggccgtgccactgccgccggcgcggctgtaccagcagctgctgctgcgcgcgtcgtcggggccgcccaagctctaccgcggcgtgcggcagcgccactgggggaagtgggtggcggagatccgcctcccgcggaaccgcacgcgcctgtggctcggcaccttcgacacggccgaggacgcggccatggcgtacgaccgcgaggcattcaagctccgcggcgacaacgccaggctcaacttccccgacctgttcctcggcaagggccgcgtcggcgggagcggacgcaccagcgcggcggcctcgtgctcctcgtctgctccgccgacgccggacgacagccacatgaagcaagctgctcagcagcagcagcgtgtgcgtgacggtgagcagccgtgcagcggcgaagcgaagcctctgctcccggaaacggaaacagagcgggcagacaactcggaacccaaaccgaatcctgagctccagtcggccgatcaccaaggcgacggcaccacggccatgtttcagccttcgggcggcgtgtggggtccggccgacgaggcgtggttcagcgcctggggccctggcagctccgtgtgggactacgacatggacaacgcccacggcctcttcctccagtctcgcttcgccagtgaggcgaccagcatggactacgtgcccagcacgccggaagtcccggcagtagggaccgccgtggcctccctttctcctcctcctcctcctccccgcagtccaacctacatgaaggagaaggac

SEQ ID NO: 216 - protein, 445 aa, Zea mays
  GRMZM2G300924_T01
MEPVGGDGGGGRGRGRGRSWKGKGVSSGSAAGRQLAPVLEDAPAAALLRPLKKIRSPDRRLNRSLSSLSPAPPSPDSSSAFNPTPLPSARQIFLAPEASTAGSPRLLPLLQYSSEFQRPMTPPPPDQQQLQQMISFGSSQQPRQEFVAAAAATPLFPPQLVAPEVQQQMLLRYWSEALNLSPRGFRGGAVPLPPARLYQQLLLRASSGPPKLYRGVRQRHWGKWVAEIRLPRNRTRLWLGTFDTAEDAAMAYDREAFKLRGDNARLNFPDLFLGKGRVGGSGRTSAAASCSSSAPPTPDDSHMKQAAQQQQRVRDGEQPCSGEAKPLLPETETERADNSEPKPNPELQSADHQGDGTTAMFQPSGGVWGPADEAWFSAWGPGSSVWDYDMDNAHGLFLQSRFASEATSMDYVPSTPEVPAVGTAVASLSPPPPPPRSPTYMKEKD

SEQ ID NO: 217 - DNA, 1380 bp, Setaria italica
  Si019997m
atggagccggcggacaggggcggtggagggcgcgggaggggctggaaggggaagggcgtgagctcgggctccgccgcggggaggcagctggcgccagttttagaagacgcgccggcggccgcattgctccggcccctgaagaagatccgcagccccgaccgccgcctcaaccgctccctgtccgcgctctcgtccgctcccccgtcccccgactcgtcctctgtttccaaccccatgtcgccgccggccacgtcgctgccgtcgacgcgacacatatttccgttcgcgtacgatccggccccggcggcgtcgacagcatcgacagcagcagcggcgacggcaccgaggctcatgccgctgatgcagtactccagcgtgtaccagcagcccctgcccccgcagcaacagcagcctttgcagcaccagcagatgatttccttcggcggcggtcagcatcagcagccgccgccgcagttcgcggcggcggcgagccctctgttcccgccgcagctcgtggcgccggaggtgcagcagcaaatgctgctccgctactggagcgaggcgctgaacctgagcccccgcgggttccgcggcggggccgtgccgccggcgctgttccagcagctgctgcgggcgccgggcccgcccaagctctaccgcggcgtgcggcagcgccactgggggaagtgggtggcggagatccgcctcccgcggaaccgcacgcggctgtggctcggcaccttcgacaccgccgaggacgccgccatggcgtacgaccgcgaggccttcaagctccgcggcgagaacgccaagctcaacttccccgacctgttcctcggcaagggtcgcgtcggcgggagcggccgcaccagcgccagcgcggcggcgtcgtgctcctcctcctcgtcctctgctccgccgacgccggacgacaccaacacgaagcaagcacagcaccatcacggagagcaaccgttcaacagtgaagcgaagcctctgctccccgaaacagagcaggcaaagaactcggaacccgaaccaaatcctcagctccaaccggccgatcatcagggcggtgacggtaacgcggccatgttcaagccgtcggtgacgtccagcggcgggtggggtccggccgacgaggcgtggttcagcgcctggggcccgggcagctccgtctgggactacgacatggacaacgcccacggcctcttcctccagtctcgcttcgccagtgaggtgaccagcatggactacgtgcccagcgccccggatgtcccggtgacaccggcggcagggacagccatggcctctgctgcctccatttctcttccatctcctccacctcctccccgcagtccggcctacatgtggaaggac

SEQ ID NO: 218 - protein, 460 aa, Setaria italica
  Si019997m
MEPADRGGGGRGRGWKGKGVSSGSAAGRQLAPVLEDAPAAALLRPLKKIRSPDRRLNRSLSALSSAPPSPDSSSVSNPMSPPATSLPSTRHIFPFAYDPAPAASTASTAAAATAPRLMPLMQYSSVYQQPLPPQQQQPLQHQQMISFGGGQHQQPPPQFAAAASPLFPPQLVAPEVQQQMLLRYWSEALNLSPRGFRGGAVPPALFQQLLRAPGPPKLYRGVRQRHWGKWVAEIRLPRNRTRLWLGTFDTAEDAAMAYDREAFKLRGENAKLNFPDLFLGKGRVGGSGRTSASAAASCSSSSSSAPPTPDDTNTKQAQHHHGEQPFNSEAKPLLPETEQAKNSEPEPNPQLQPADHQGGDGNAAMFKPSVTSSGGWGPADEAWFSAWGPGSSVWDYDMDNAHGLFLQSRFASEVTSMDYVPSAPDVPVTPAAGTAMASAASISLPSPPPPPRSPAYMWKD

SEQ ID NO: 219 - DNA, 1308 bp, Brachypodium distachyon
  Bradi3g49810.1
atggaactggcgccggttttagaagacgcgccaccggccgcattgctccggccactgaagaagcccgattgccgcctccaccgctccgtgtcttcgctgtcgtcggctcctgcttcctctggctcgtcctctgtctccgaccccatctcgccgcctgcggtggggtcctccttgccttatccgtcgccgggatcgacgcggcatatatttccgttcgcgtacgatccgtcccctgcggcggcaccgaggctccttcagctgttgcagtactcctctagcctgtaccaacagcagcctctcctgccgcagcagctccaacagcaacaacaacagacacctttgcagaatcagcagatgatctcgttcggcgacgcccagcacgaggcgcagcagcctcccctgatcccgccgcagctcatggcgccggaagcgctgcgctactggagcgaagcgctgaacctgagcccccggggcgtgctcggcgggctcgtgccggtgccgcagtcgctgttccagcacctgctgcgggcgccggtcccggccaagctgtaccgcggcgtgcggcagcgccactgggggaagtgggtggcggagatccgcctgccgcggaaccgcacgcggctgtggctcggcaccttcgacaccgccgaggacgccgccatggcgtacgaccgcgaggccttcaagctgcgcggcgagaacgcgcgcctcaacttccccgacctcttcctcggcaaaggacgcgccggcgggagcggccgcaccagcgccagcgccgctgcgtcccgctcctcttcctcctgttcgtccgctccgcccacgccggacgagacccgcacgcagcaagctcgtcaggcgctgctgctgcgtgaacagcagcagcagcagcagcaggagcatttggaagagccatcggacattgaaccgacacctctgttctctgcagcagaggagcaggaaggcatcccggaagccgagcaaagtcctcagcttctccataaggcagaacagcaatgcggcgaaggcagcacggccatggcgcaggctccagtgacctccggcggcgtttgggggccggccgacgaggcatggttcagcgcgtggggcccgggcagctccgtctgggactacgacatggacagcgcgcatggtctctttctccagtctcgcttcgccggcgagcagaccggcatggactacgtccccagtgcgccggaagcccacatggcaccggcaccaggggcagcttctccttctctccctcctcgtcctcccccttctcacagtccaaccttcgtgtggaaggac

SEQ ID NO: 220 - protein, 436 aa, Brachypodium distachyon
  Bradi3g49810.1
MELAPVLEDAPPAALLRPLKKPDCRLHRSVSSLSSAPASSGSSSVSDPISPPAVGSSLPYPSPGSTRHIFPFAYDPSPAAAPRLLQLLQYSSSLYQQQPLLPQQLQQQQQQTPLQNQQMISFGDAQHEAQQPPLIPPQLMAPEALRYWSEALNLSPRGVLGGLVPVPQSLFQHLLRAPVPAKLYRGVRQRHWGKWVAEIRLPRNRTRLWLGTFDTAEDAAMAYDREAFKLRGENARLNFPDLFLGKGRAGGSGRTSASAAASRSSSSCSSAPPTPDETRTQQARQALLLREQQQQQQQEHLEEPSDIEPTPLFSAAEEQEGIPEAEQSPQLLHKAEQQCGEGSTAMAQAPVTSGGVWGPADEAWFSAWGPGSSVWDYDMDSAHGLFLQSRFAGEQTGMDYVPSAPEAHMAPAPGAASPSLPPRPPPSHSPTFVWKD

SEQ ID NO: 221 - DNA, 1347 bp, Zea mays
  GRMZM2G139765_T01
atggagccgatgggcagggacggcggtggaggccacgggaggggctggaaggggaagggcgtgagctcgggctccgccgcggggaggcagctggcgccagttttagaagacgcgccggcggccgcattgctccggcccttgaagaagatccgcagccccgaccggcgcctcaaccgctccctgtccgcgctctcgtcgtcggctcccccttcccctgactcgtcctccgtttccaaccccatgtcgccgccgtcgacgcgacacatatttccgttcgcgtacgatccggctccggcggcatcgacgtccacggctgcgtcgccaaggctcctgccgctgttgcagtacggcagcgtgttccagcagcctctgccgccgcagcagcctttgcagcaccagcagatgatttcgttcggaagcagacagcaacagttcggggcggccgcggctcctctgttcccgccgcagctcgtggcgccgccggaggtgcagcagcaaatgctgctgctgcgctactggagcgaggcgctgaacctgagcccccgggggttccgcgccggggccggggccggggccgtgccgccggcgctgtaccagcagctgctgcgcgcgcccaagctctaccgcggcgtgcggcagcgccactgggggaagtgggtggcggagatccgcctcccgcgcaaccgcacgcgcctgtggctcggcaccttcgacaccgccgaggacgccgccatggcgtacgaccgcgaggccttcaagctccgtggcgagaacgccaagctcaacttccccgacctgttccttggcaagggccgcgtcggcgggagcggccgcaccagtgccagtgcagccgtgtcctgctcctcctcttcgtcgtctgctccgccgacgccggacgagaatcacgcgaagcaagctcagcggcatgacggtgagcagccgtgcaacagcgaagcgaagcctctgttcccggaagcagagcagccaaacaacttggaacacgaaccgaattctcagctccaatcggccgatcaccatggcggtgacggcagcacggtcatgtttcagccgtcggtggcgtcgagcggcatgtggggcccggccgaggaggcgtggttcagcgcctggggcccgggcagctccgtgtgggactacgacatggacaacgcccacggcctcttcctccagtctcgcttcgccagtgaggctgccagcatggactacgtgtccagcatgccggaagccccggcgacaccggcggcagggactgccgtggcctccgctgcttccctttcttctcctccccctcttcctcttccccgcagtccaacctacaggtggaaggac

SEQ ID NO: 222 - protein, 449 aa, Zea mays
  GRMZM2G139765_T01
MEPMGRDGGGGHGRGWKGKGVSSGSAAGRQLAPVLEDAPAAALLRPLKKIRSPDRRLNRSLSALSSSAPPSPDSSSVSNPMSPPSTRHIFPFAYDPAPAASTSTAASPRLLPLLQYGSVFQQPLPPQQPLQHQQMISFGSRQQQFGAAAAPLFPPQLVAPPEVQQQMLLLRYWSEALNLSPRGFRAGAGAGAVPPALYQQLLRAPKLYRGVRQRHWGKWVAEIRLPRNRTRLWLGTFDTAEDAAMAYDREAFKLRGENAKLNFPDLFLGKGRVGGSGRTSASAAVSCSSSSSSAPPTPDENHAKQAQRHDGEQPCNSEAKPLFPEAEQPNNLEHEPNSQLQSADHHGGDGSTVMFQPSVASSGMWGPAEEAWFSAWGPGSSVWDYDMDNAHGLFLQSRFASEAASMDYVSSMPEAPATPAAGTAVASAASLSSPPPLPLPRSPTYRWKD

SEQ ID NO: 223 - DNA, 1428 bp, Eucalyptus grandis
  Eucgr.K00961.1
atggctgcggcgaagaacaccgggaaatcgagaaggggcgttgatgagagccagaagatgacggagttggagacgggcaagggagactatgagttcagcttggatagccagcagtggaggcctgtgtttggagaagcttccatgtcgggtaggcctctcaagaagatccggagcccggagaggcaagcgagcttccagttatcatcgtcttcttccacgcatcagaatcaaacacctttcgccatgccttcctctgttcctcctacctcagcctcgtcggtcggtcactctcccatggctccttcgtcttcgcacaactctccgagattgatctttccttttgctctggagggagcccaacatcacgggcagttccagcaacagctcgggaccgtgccgtatcacgcgtttcggccggcgctccagctccaacctccgcaaaaccaggggcagcagcagcagcagcagcagatgatatctttcacctcgcaacagcagcagcagcagcagcagcagctaagccttaatcagccgctgtataatttcgcaggtgacttgtccccattgcagcacccccagcagaggctgctgcagtactggagtgacgcgctgaatctcagcccgagggggaggatgatgatgatgaatcggttggggcccgacggcaggccgatcttccggcctccgcagccgataaacaccacgaagctctatcgtggagtgaggcagcggcattggggcaagtgggttgcagagattcgcttgccgaggaaccgaacccgactctggctcggaaccttcgacacagccgaggatgcagccctggcctatgaccgcgaggcgttcaagctacgaggggagaatgccaggctcaatttccccgagcttttcctcaacaaggacaaggctgaggaatccgctggtccaagctcgtcatcttcgtcaccccccaaggatgaaaacgtgatcactcgccaatacatgaagacttctccgcaagcttcagaagatcccacccagcaggactcgtccatggagctgatgacctcgccgcctcaggaaaccaatcccgatggggattcgggaataggatcgagcgaggccacggcaagtgaagcggttcaaggggtggcaggaagtagcattgcaggggaaggaggctcggtctcgcaggagatggtgtggagggaaatggcggaggcttggtgcaatgcgatgccggccggctggggaccgggcagtccagtatgggatgatttggatgcaagcagcaatattctgctgccatcacaccttcctttcggccatgggaacgagcaggagttcgacgagaataatgtccggaggcagcaggaaaatttctgtgccgcttcatcatcgtcgtcaagctcttgccctatgaaacccttcttttggaaggatcaagat

SEQ ID NO: 224 - protein, 476 aa, Eucalyptus grandis
  Eucgr.K00961.1
MAAAKNTGKSRRGVDESQKMTELETGKGDYEFSLDSQQWRPVFGEASMSGRPLKKIRSPERQASFQLSSSSSTHQNQTPFAMPSSVPPTSASSVGHSPMAPSSSHNSPRLIFPFALEGAQHHGQFQQQLGTVPYHAFRPALQLQPPQNQGQQQQQQQMISFTSQQQQQQQQQLSLNQPLYNFAGDLSPLQHPQQRLLQYWSDALNLSPRGRMMMMNRLGPDGRPIFRPPQPINTTKLYRGVRQRHWGKWVAEIRLPRNRTRLWLGTFDTAEDAALAYDREAFKLRGENARLNFPELFLNKDKAEESAGPSSSSSSPPKDENVITRQYMKTSPQASEDPTQQDSSMELMTSPPQETNPDGDSGIGSSEATASEAVQGVAGSSIAGEGGSVSQEMVWREMAEAWCNAMPAGWGPGSPVWDDLDASSNILLPSHLPFGHGNEQEFDENNVRRQQENFCAASSSSSSSCPMKPFFWKDQD

SEQ ID NO: 225 - DNA, 1407 bp, Populus trichocarpa
  POPTR_0013s13920.1
atggctgcagctaagaataattttggaaaatccaagaagggtgttgttgatgaaactcgaaagatgatgatggaacaagattggcagcttgatagaggcaaaaaagaagctgatgttagcttcgagaggaggcaatggaaaccggtttttggtgaagcttccttgatggataggcctttgaagaaaatctgtagccctgaacgtcaagaacagatacaatcctctgcatctttagctcatcaattaccatcttgtttctctgtctcttctagctctgcctcgactctgtctctgtatccgccttcttcgtcgccttcacctatgtcatcttcaagttccagacttgtgtttccttttgcctttgaagggtctaatcaacctattcagtgccctcaacaatttagaacaaacccttcattgccaattttccatccactgtctcaagttgcacagaatcaacagcaaatgatttcttttggtcaaaaccagcaacatggcattgcatatcctccgttttatgctggaggattaccaatggctgaccaccaccaccaccaccagcagctgtttcagtactggagtgatgcattgaacttaagtccgagaggaaggatgatgatgatgaacaagctggggccggacggaaggccattgtttaggcctccgattcagcctataaacacaagaaagctttataggggagtgagacaaaggcattggggaaaatgggttgccgagattcgtctccctcgaaataggactcgcctttggctaggcacatttgatactgccgaagatgctgccttagcttatgatcgcgaggccttcaagttaagaggagagaatgctaggctgaatttccctgaacttttcctcaacaaagataaagcaacttccacagctccaagttcaacagtttcttctccgccgacttccaatcaaagtttaaagccaaaacaagcccaagaaggccttaacttgcaggcagaaaccatgtcaccaccaatattaccaccacaaccaccaccagaacaacctccaggagaccatcctgatgatgattccgggatgggttcgagtggggctactgtgagtgatgagattcaggcagtggcagaggggtctagtgcaggggaaggcatttcggggtctcaagaattggagtggggagacatggcagaagcttggtataatgctattcaagcaggttggggtccagggagtcctgtgtgggacgatttggactccactaacaatcttttattacaatctcaccttccttttgttaatccaaatcaacagcagtttaatgattcttgttgtgttctccaagacaacatgggctcagcttcttcttcttcctcctctttcttcccaatgaagtcatactttttgaaggatcaagat

SEQ ID NO: 226 - protein, 469 aa, Populus trichocarpa
  POPTR_0013s13920.1
MAAAKNNFGKSKKGVVDETRKMMMEQDWQLDRGKKEADVSFERRQWKPVFGEASLMDRPLKKICSPERQEQIQSSASLAHQLPSCFSVSSSSASTLSLYPPSSSPSPMSSSSSRLVFPFAFEGSNQPIQCPQQFRTNPSLPIFHPLSQVAQNQQQMISFGQNQQHGIAYPPFYAGGLPMADHHHHHQQLFQYWSDALNLSPRGRMMMMNKLGPDGRPLFRPPIQPINTRKLYRGVRQRHWGKWVAEIRLPRNRTRLWLGTFDTAEDAALAYDREAFKLRGENARLNFPELFLNKDKATSTAPSSTVSSPPTSNQSLKPKQAQEGLNLQAETMSPPILPPQPPPEQPPGDHPDDDSGMGSSGATVSDEIQAVAEGSSAGEGISGSQELEWGDMAEAWYNAIQAGWGPGSPVWDDLDSTNNLLLQSHLPFVNPNQQQFNDSCCVLQDNMGSASSSSSSFFPMKSYFLKDQD

SEQ ID NO: 227 - DNA, 831 bp, Glycine max
  Glyma13g37450.1
aggcgtcaatggaagccagtttttgatgacgcttccatctcatacaatagacctctcaagaaaatccgcagccccgatcgccaagaaacaaaccaatcttcttcttcttcttcttctactactccttttgaaccttctccactctctaatcctcctccttcctcttcaagaatagtgtttccttttgcttttgatggttcccaacaccccatgcaattccctcaccaatttggaaccacaacaaactcacctttccctcacccatctttccaaaaccagcaacaccagatgatatcatttggcccgagattcttcttcacttgtacatcatcatcatcaacaacaacaacagcatcagcagcaacttcttcagtattggagtggcgcgttgaatctaagccattgtttagtcctccaacacagcgcataaacacaacaaaactctataggggagtgaggcaacgccattggggcaaatgggtcgctgaaatccgtcttccacgaaacagaacgcgtctctggctaggcacatttgacacggccgaagacgccgccatggcctacgaccgcgaagccttcaagcaacgaggagagaatgcaaggctcaatttccccgaattgttcttcaacaaggacaaaaaagaacaaggagaagaagaagcttcttcgccgtctaacgaaaatgactcaggtgacgccaccgtgagcgacgaggttcatgctcctgctgctacagcgagttccgaaggggtttctcaggaactggtttggggagaaatgtctgcatggttcaatgctattcctgctgcttggggtcctggtagtcccatg

SEQ ID NO: 228 - protein, 277 aa, Glycine max
  Glyma13g37450.1
RRQWKPVFDDASISYNRPLKKIRSPDRQETNQSSSSSSSTTPFEPSPLSNPPPSSSRIVFPFAFDGSQHPMQFPHQFGTTTNSPFPHPSFQNQQHQMISFGPRFFFTCTSSSSTTTTASAATSSVLEWRVESKPLFSPPTQRINTTKLYRGVRQRHWGKWVAEIRLPRNRTRLWLGTFDTAEDAAMAYDREAFKQRGENARLNFPELFFNKDKKEQGEEEASSPSNENDSGDATVSDEVHAPAATASSEGVSQELVWGEMSAWFNAIPAAWGPGSPM

SEQ ID NO: 229 - DNA, 1398 bp, Oryza sativa
  LOC_Os04g44670.1
atggacgctccgagcggcgagagcggcggcggcggcggcggcggtggtggcaggaggtggaaggggaagggggtgacgcccatacagccgcggcggcagctggggacggttttggaggactcgtcggcggcattgctgcggccgctcaagaagattgggcggagccccgaccgcctcctccgctccgcatcgtcgctctccacgtcctcgtcggctccgccttcgcctcgctcttcttcggcttccgatgctccagtccgcgtcatctcgtcgtcgccgtcgtcgccctcgccaccgtcggcgcgacacatcttccccttcgcgtacgaggcctccacgacgacggtgggtgggagcccaaggctccacccgctgtcgtggcagcaatccagcatgtcccagcccgcgtcgccacagcaacagcagcagcagccgttgcagcaccagcagatgatatcgttcggcgcgtcgcctccgtgctcgacgacgcagttcgtcgtcccggagaacgcgcagcagcagcagatgctgctgcggtactggagcgaggcgctgaacctgagcccgcgcggtggccccggtggcgtgccaccgtggctgtaccagcagctgctccgggtcccgccaccgccgcagaagctttaccgcggcgtgcggcagaggcactgggggaagtgggtcgcggagatccgcctgccacggaaccgcacgcggctgtggcttggcaccttcgacaccgccgaggacgccgccatggcgtacgaccgcgaggccttcaagctccgcggcgagaacgcgcggctcaactttccggaccggttccttgggaagggccgcgccggcgggaaaggccgcaccagcgtaagctcctcggccgctgccgccgcgtcgtgctcgtcgtcgtcgctatcgccaccggagacacctgacgacgcaaacacgcagcaacaagctcctcagcagcgagaacagcgggacacggcaggagtgtccatggagaagaaacaaccacagcctccagctccaacctctcgtcaagaagggtgctctggcggcgacgcagctgcgccgtacccggccgaaatgcttcacgcgccggcggcgtgcggcggcatgtgggttgctcccgacgagtcatggttcagcacgtggggccctggcagctccttctgggacgactacgacatggacagcgctcgcggcctcttcctccaccctcgcttcaccggtgacgaaactagcatggatcattccggcacgcaagcaaccgtgccggcagtggcagcaacagcggcagggatgagcatgccatgcgatgatgttccggtaacctcttcttcttcagatctccctccccaagggacacctcagactcctaccttcatgtggaaggaggac

SEQ ID NO: 230 - protein, 466 aa, Oryza sativa
  LOC_Os04g44670.1
MDAPSGESGGGGGGGGGRRWKGKGVTPIQPRRQLGTVLEDSSAALLRPLKKIGRSPDRLLRSASSLSTSSSAPPSPRSSSASDAPVRVISSSPSSPSPPSARHIFPFAYEASTTTVGGSPRLHPLSWQQSSMSQPASPQQQQQQPLQHQQMISFGASPPCSTTQFVVPENAQQQQMLLRYWSEALNLSPRGGPGGVPPWLYQQLLRVPPPPQKLYRGVRQRHWGKWVAEIRLPRNRTRLWLGTFDTAEDAAMAYDREAFKLRGENARLNFPDRFLGKGRAGGKGRTSVSSSAAAAASCSSSSLSPPETPDDANTQQQAPQQREQRDTAGVSMEKKQPQPPAPTSRQEGCSGGDAAAPYPAEMLHAPAACGGMWVAPDESWFSTWGPGSSFWDDYDMDSARGLFLHPRFTGDETSMDHSGTQATVPAVAATAAGMSMPCDDVPVTSSSSDLPPQGTPQTPTFMWKED

SEQ ID NO: 231 - DNA, 1419 bp, Oryza sativa
  LOC_Os02g42585.1
atggacgcggtggacagaggcggaggcggaggcggtggaggagcgcgcgggcacgggcggagatggaaggggaagggagtgagcgcggcgatctcctcctccgcggccgagacgcagcagccggtgccagttttagaagacgcgccggcggccgcagcattgctccgtccccagaagaagatccgcagccccgatcgtcgcctccagcgctccatctcctcgctgtcgtcggcccctgcttcccccgactcgtcctctgtctccaaccccatgtctcccccggcgatgtccttgccgaatcagccgccatcgtcgcgacatatatttccgttcgcgtacgatccgtctccgggcgcggcggcaccaaggctcctcccgctgctgcagtactccagcttgtacccgcagcctctgctgccgcagcagcaatcacccttgcagaatcagcaaatgatatcgttcggcagtagccagcagcagcagcagcagcagccgcagtttggggcggcgtctcctctgttcccgccgcagttcttgccgccggaggagcagcagcgcctgctgctgcgctactggagcgaggcgctgaacctgagccccccaggcgtgcgcggcggcgccctgccgccgtcgctgtaccagcacctgctgcgcgcgcctgggccgcccaaactgtaccgcggcgtgcggcagcgccactgggggaagtgggtggcggagatccgcctgccgcggaaccgcaccaggctgtggctcggcacgttcgacaccgccgaggacgcagccatggcgtacgaccgcgaggccttcaagctccgcggcgagaacgcgcggctcaacttccccgacctcttccttggcaaaggccgcaccggcgggagcggacgcaccagcgccagcgccgcggcctcctgctcctcctcctcctcttcggctccgcctacaccggacgagagccacacgcagcaagctcagccgcagccgcagcagcctacagaagagtcatccaacactgaaccgaagcctctgctcttcgtagcagagcaggacggcattccagaacccgagctgaatcctcagctccagacagctgaacaacatggcagcgacggcaacacggccatgttccagccgtcggtgacgtccggcggcatttggggtccggccgacgaggcgtggttcagcgcttgggggccaggaagctccgtctgggactacgacatggacagcgcccacggcctcctcctccagtctcgcttggccggtgagcagaccggcatggactacgcctacaccgcgccggaagtcctcgtggcaccggtgccggcggcagggacagccatggccactgccgcttcctcctctcttcctcctcgtcctccccctccttgccacagtccaaccttcgcatggaaggac

SEQ ID NO: 232 - protein, 473 aa, Oryza sativa
  LOC_Os02g42585.1
MDAVDRGGGGGGGGARGHGRRWKGKGVSAAISSSAAETQQPVPVLEDAPAAAALLRPQKKIRSPDRRLQRSISSLSSAPASPDSSSVSNPMSPPAMSLPNQPPSSRHIFPFAYDPSPGAAAPRLLPLLQYSSLYPQPLLPQQQSPLQNQQMISFGSSQQQQQQQPQFGAASPLFPPQFLPPEEQQRLLLRYWSEALNLSPPGVRGGALPPSLYQHLLRAPGPPKLYRGVRQRHWGKWVAEIRLPRNRTRLWLGTFDTAEDAAMAYDREAFKLRGENARLNFPDLFLGKGRTGGSGRTSASAAASCSSSSSSAPPTPDESHTQQAQPQPQQPTEESSNTEPKPLLFVAEQDGIPEPELNPQLQTAEQHGSDGNTAMFQPSVTSGGIWGPADEAWFSAWGPGSSVWDYDMDSAHGLLLQSRLAGEQTGMDYAYTAPEVLVAPVPAAGTAMATAASSSLPPRPPPPCHSPTFAWKD

SEQ ID NO: 233 - DNA, 1461 bp, Brachypodium distachyon
  Bradi5g16450.1
atggacgcatcgggcgagagcggcggcggcggtcgtgggagtactgggaggagatcagggaagggcttgacgcccatacaggcgcggcggcagcagcagcagctggcgccggttctggaaaacgcgtcggcggcggcattgctgcgcccgctcaagaagatcgggaggagcccagaccgcctccaccggaccacgtcgacgctctccaccacgtcctcctcctcctcggctcccgcctcgcctcggtcctcctctgtgtccaacgccgccgtctcgccgccttccgcgcgtcacatcttcccctacgcgtacgagccaattatcgcgcctgctgcctcgacaacgacgacgcacgggaggagcccgcggcttgatctccatccctggccgcagtcgtcaaccagcgtatcccagccggcgtcgcctcagcctctgcggcatcagcagatgatatccttcggcgcgtcgtcgcctccgtactgcgcggcgcagtcgttcctggtgccagccgagagcgcgcagcatcagcaccagctgctgcggtactggagcgaggcgctgaacctgagcccccgcggcggcccggccatgccgccgtcgatgtaccagcagttgctgctgcaggcgcctccgccgccaccgccacagaagctgtaccgcggcgtgcggcagcggcactgggggaagtgggtggcggagatccggctgccccggaaccgcacgcggctgtggctcggcaccttcgactccgccgaggacgccgccatggcctatgaccgcgaggccttcaagctccgcggcgagaacgcgcgcctcaacttccccgaccgcttcctcgccaagggccgcgccggtggcagcggccgcaccagcgccagctccgctgctgcttctgcctcgaccgccgccgccgcctcgtgctcctcttcgtcttcgtcgcctccgcaagcttctgacgaggcgccgttcaacacgcagcagcagcagcagcagcaagcagaagggacgacgtcctttgagaaccaattacagcagcatccgcttagtccaacggcgacgaccatccaggaaactacaggcagctctcgtgacgcggctacggcgccgtattcggccgagatgtttcacgcgtcggcggtggcatcatcatccggtggcgccatgtgggctccgcccgacgaggcatggttcaacgcgtggggccccggaagctccttttgggactacgacatggaagacgacggcgcccgcggcctcttcctccaccctcgcttctccggtgacgatgccggcgtggtgcattctggcgcgcaggaaatagcagcagggacgtcgggcacgccgtggccgtgcccatgcgatgacgacgtcccggtaatctcctcttcagctcctcctcctcctcctcctcctcctccccccgagacagctcaggctcctagcctcatgtggaagcaggac

SEQ ID NO: 234 - protein, 487 aa, Brachypodium distachyon
  Bradi5g16450.1
MDASGESGGGGRGSTGRRSGKGLTPIQARRQQQQLAPVLENASAAALLRPLKKIGRSPDRLHRTTSTLSTTSSSSSAPASPRSSSVSNAAVSPPSARHIFPYAYEPIIAPAASTTTTHGRSPRLDLHPWPQSSTSVSQPASPQPLRHQQMISFGASSPPYCAAQSFLVPAESAQHQHQLLRYWSEALNLSPRGGPAMPPSMYQQLLLQAPPPPPPQKLYRGVRQRHWGKWVAEIRLPRNRTRLWLGTFDSAEDAAMAYDREAFKLRGENARLNFPDRFLAKGRAGGSGRTSASSAAASASTAAAASCSSSSSSPPQASDEAPFNTQQQQQQQAEGTTSFENQLQQHPLSPTATTIQETTGSSRDAATAPYSAEMFHASAVASSSGGAMWAPPDEAWFNAWGPGSSFWDYDMEDDGARGLFLHPRFSGDDAGVVHSGAQEIAAGTSGTPWPCPCDDDVPVISSSAPPPPPPPPPPETAQAPSLMWKQD

SEQ ID NO: 235 - DNA, 1392 bp, Populus trichocarpa
  POPTR_0019s13330.1
atggattcagctaagaataacactggaaaatccaagaagggtgttgttgatgaaactcaaaggctggcaatggaccaagattggcagcttgatagaggcagaaaagaagctgatattagctttgagaggcggcaatggaagccggtttttggtgaagcttccttgtcagacaggccttccaaaaaaatccgtagccctgaacgtcaagaacaaactcaatcctctgcatatttagctcatcaattgccaccttctttctctgtttcttctagctctgcctctactctgtctttatatccgccttctttgtcgtcttcgcctgtgtcatcttcaagttcaaaacttcagtttccttttgcctttgaagggtctaatcaacctgttcaattccaccaacaagttggaacaaacccttcatcaactatctttcgtccaccatctcaagttgcacagaatcagcagcaaatgatttcttttggtcaaaaccagcaatatggcattgcatatcctccgttttttgctggggaatctgcattggctaaccagcagcagcagcaacagcagctgtttcagtactggaatgacgcattgaacttaagtccgagaggaaggatgatgatgatgaacaggctggggccaaatgggaggccattgtttaggccaccgattcagcctataaatacaacaaagctttataggggagtgaggcaaaggcactggggaaaatgggttgccgagattcgtctccctcgaaatagaactcgcctttggctaggcacatttgacaatgcagaagatgctgccttagcttatgatcgcgaggccttcaagttgagaggagagaatgctaagctgaatttccctgaacttttcctcaacaaagaaaaagaaacttccacagctccaagttcatcagtttcttctccaccaacccccaatcaaagttcaatgccaaaacaagcccaggaaggcattaacttgcaggtggaaaccatgccgccgccgccgccaccagaacagccccaaggagaccatcctgatgatgattccgggttgggttcaagtggggctacggtgagtgatgaggttcaggcagtgggatccagtgcaggggaaggcacttcggggtctcaggaactgatgtggggagacatggcagaagcttggtataatgctattcaagcaggttggggtccagggagtcctgtgtgggacgatttggacaccactaacaattttttattacaatcacaccttccttttgttactccaaatcaacagcagtttactgattcttctgatctccagagacaacaagacaacatgggctcagcttcttcttcttcttcctcttccttccccacgaagccattcttttggaaggatcaagat

SEQ ID NO: 236 - protein, 464 aa, Populus trichocarpa
  POPTR_0019s13330.1
MDSAKNNTGKSKKGVVDETQRLAMDQDWQLDRGRKEADISFERRQWKPVFGEASLSDRPSKKIRSPERQEQTQSSAYLAHQLPPSFSVSSSSASTLSLYPPSLSSSPVSSSSSKLQFPFAFEGSNQPVQFHQQVGTNPSSTIFRPPSQVAQNQQQMISFGQNQQYGIAYPPFFAGESALANQQQQQQQLFQYWNDALNLSPRGRMMMMNRLGPNGRPLFRPPIQPINTTKLYRGVRQRHWGKWVAEIRLPRNRTRLWLGTFDNAEDAALAYDREAFKLRGENAKLNFPELFLNKEKETSTAPSSSVSSPPTPNQSSMPKQAQEGINLQVETMPPPPPPEQPQGDHPDDDSGLGSSGATVSDEVQAVGSSAGEGTSGSQELMWGDMAEAWYNAIQAGWGPGSPVWDDLDTTNNFLLQSHLPFVTPNQQQFTDSSDLQRQQDNMGSASSSSSSSFPTKPFFWKDQD

SEQ ID NO: 237 - DNA, 1212 bp, Zea mays
  GRMZM2G040664_T01
atggacgcgtcgagcgagagctgtggcggtggcgcggggggcggtcgtggaggcaggaggtggaagggcaaaggcgccacgcccatccagccgcggcggcagctggcaccggtcatggaggacgcgtcggcggcactgctgcgcccgctcaagaagatcggacgggcgccggaccgcttccagcggtccgcttcgtcgctgtcgacgtcgacgtcttcgtcggccccgccttcgcctcgcgccacctcgccggcgccgcactccgccagcgtgtcacagccggcttcgccgcaggttcaagcgcctatgcagcgccagcagcagatcatatcgttcggcccgccgactcagtaccagacgccgttcttgctgccggagggcgcgcaacagcagcagcatcttctgcggtactggagcgaggcgctgaacctgagcccgcgcggcggccagcaggtcgcgggcgtgctgccttcgcggtaccagcacctgctgcgggctccgccgcctccgcttcagaagctgtaccgtggcgtgcggcaacggcactgggggaagtgggtggccgagatcaggctgccgcgggaccgcacgcggctctggctcggcacgttcgactccgccgaggacgccgccatggcgtacgatcgcgaggcgttcaagctccgcggcgagaacgcacggctcaacttcccggaccggttcttcgggaagggccacgccggggggagcggccgcaccggcgccacatccgcgtcgggctccacatcgtcgtcgtcaactccacagactcctggcgagcaaaacacgcagcaagcgccgccggacgcggaaggatcgtcggacaagcggcctcagcctccggttgcgacatcgtcgcagctacaaggcggctctggtgagacgaccttgccagactccgatcaaatgattcactcaccggaggctcctggcagcgagtggggttcggccgacgaggcatggctcaacgtgtggggcccaggaagctccttctgggactacgacattgagagcacccgcggcctctttcaccatcacgggcgcttcgacggtgatgagaccggcataaacacagcgacaactgcggcggcaaccggggcgggcatgtcatgcgatcatgtcccggtaacacctgcttcttcttcttcctcccctctgcactcacagtctcctccttcacccaccttcatggac

SEQ ID NO: 238 - protein, 404 aa, Zea mays
  GRMZM2G040664_T01
MDASSESCGGGAGGGRGGRRWKGKGATPIQPRRQLAPVMEDASAALLRPLKKIGRAPDRFQRSASSLSTSTSSSAPPSPRATSPAPHSASVSQPASPQVQAPMQRQQQIISFGPPTQYQTPFLLPEGAQQQQHLLRYWSEALNLSPRGGQQVAGVLPSRYQHLLRAPPPPLQKLYRGVRQRHWGKWVAEIRLPRDRTRLWLGTFDSAEDAAMAYDREAFKLRGENARLNFPDRFFGKGHAGGSGRTGATSASGSTSSSSTPQTPGEQNTQQAPPDAEGSSDKRPQPPVATSSQLQGGSGETTLPDSDQMIHSPEAPGSEWGSADEAWLNVWGPGSSFWDYDIESTRGLFHHHGRFDGDETGINTATTAAATGAGMSCDHVPVTPASSSSSPLHSQSPPSPTFMD

SEQ ID NO: 239 - DNA, 1398 bp, Citrus clementina
  clementine0.9_009464m
atggctgcagcaaagaacagtagcaaatccgaaaagggcgttgacgaagcaacggaggagatggttagaagccaggattgggagattgatgaaggaaaggattttgatctcagtagcttcgagaggcgacagcaatggaggccagttttagatgaagcttccgtgtctcaaagacctctcaaaaagatccgtagccctgaaagacatcaaaatcctgttaaattttcttcatcttttgattatcaatcaccttctatttcttcggtttctccagcttcagcatcaactcttggctcatcatcttcgagacttgtatttcctttcgcttttgatacatctcaacaagcaattcagtttccacaacaatttccaacgtcgcagttgcagactcctttgccaaattttcacccaccaattcaaccagcacaaactcagcaacaaatgatctcttttagcgctcaccagcagcagcagggctttccctttttcgctggagaatccatgctgcctcatcagcagcaccagcggcagcttcttcagtattggagtgatgcattgaacttgagcccacgaggaaggttgatgatgaatagaattggaccagatgggaggccattatttaggcctcaagtgcagcctttaaacactacaaagctttacaggggagtgagacagagacattggggcaaatgggtagccgaaattcgtctccctcgcaataggactcgcctttggcttggaacatttgacagggctgaagatgccgccttagcctatgaccgcgaggcctttaaattgagaggagagaatgctaggctcaatttccccgaattgtttctcaataaagataaagcagcagtgtccaccgatcctggttcaaatatttcatcgccaccatctccttatgagagttcaatgccaaatcgattgcagactcaacatgctcaaaacagtctaaattcccaagtcatgagctcagaaccaataccagctccgccaccacagcctaaagtagaaattcctgacagtgagtcaggtttagggtccagtgaggctactgcgagtgatgacgtgctggcagctgctgagggttctggttcaggagaaggggtttcaggttcacaagaattagcctggggtgaaatggcagaggcttggttcaatgcaattccagcaggttggggtccaggtagtcctgtgtgggatgattttgacagctctaacaatcttctcatgccagcaaatcttccatttgtcaaccaaagtcagcaagagttccctgattctgatcgtcagaggcagcatgacaattcagtttctgctgcttcttcaacttcacctccttgtcctatgaaacccttcttttggaaggatcaagatcacccacaagattcatct

SEQ ID NO: 240 - protein, 466 aa, Citrus clementina
  clementine0.9_009464m
MAAAKNSSKSEKGVDEATEEMVRSQDWEIDEGKDFDLSSFERRQQWRPVLDEASVSQRPLKKIRSPERHQNPVKFSSSFDYQSPSISSVSPASASTLGSSSSRLVFPFAFDTSQQAIQFPQQFPTSQLQTPLPNFHPPIQPAQTQQQMISFSAHQQQQGFPFFAGESMLPHQQHQRQLLQYWSDALNLSPRGRLMMNRIGPDGRPLFRPQVQPLNTTKLYRGVRQRHWGKWVAEIRLPRNRTRLWLGTFDRAEDAALAYDREAFKLRGENARLNFPELFLNKDKAAVSTDPGSNISSPPSPYESSMPNRLQTQHAQNSLNSQVMSSEPIPAPPPQPKVEIPDSESGLGSSEATASDDVLAAAEGSGSGEGVSGSQELAWGEMAEAWFNAIPAGWGPGSPVWDDFDSSNNLLMPANLPFVNQSQQEFPDSDRQRQHDNSVSAASSTSPPCPMKPFFWKDQDHPQDSS

SEQ ID NO: 241 - DNA, 1356 bp, Zea mays
  GRMZM2G026926_T01
atggacgcgtcaagcgagagcggtggcgcggggggcggtcgtgggggcaggaggtggaagggcaaaggtgtgacgcccatacagccgcggcggacgcagctggcgccggtcatggaggacgcgtcggcggcactgctgcgcccgctcaagaagatcggacgggcgccggaccgcttccagcgctcggcgtcgtcgctgtcgacgacgtcttcgtcggccccgccttcccctcgctccagcgctgctggcgccacctcgccagcgtcgctatcgccgccctcggcgcggcatatgttcccgttcgcgtacgagccctccgcgccgttgggcggggccccgcggctggagctcccgccgccgtggcagcactcccccagcgtgtcacagccggcgtcgccacagcagcagcagcagcagcaggctcaagcgcctgtgcagcgtcagcagcagatgatatcgttcggcgcgccgccccagtaccaggcgcagttcttgttgccggagggcgcgcagcagcagcagcatctgctgcggtactggagcgaggcgctgaacctgagcccgcgcggcgggcaggctgcgggcgtgctgccttcgctgtaccagcacctgctgcggccgccgccgcctcagaagctgtaccgcggcgttcggcagcggcactgggggaagtgggtcgccgagatcaggctgccgcggaaccgcacgcggctctggctcggcacgttcgactccgccgaggacgctgccatggcgtacgatcgcgaggccttcaagctccgcggcgagaacgcgcggctcaacttcccggaccggttctttgggaagggctacgccggggggagcggccgcaccagcgccacacccgcagccgcgccgacagctgccgccgcgtcgggctccacgtcgtcatcgtcgcctccacagactcctgatgacccaagcacgcaacaaacgccgccggacgcagaaagatcgttggacaagcagccacagcctccggttgctacatcgtcgcagctagaaggcagctctggtgagccgaccttggcagattcgggtcaaatgattcactcgccagagccacccgctggcagcgactggggtccggcggacgaggcatggctcaatgcgtggggcccaggaagctccttctgggactacgacattgatagcactcgcggcctctttctccatcacgggcgcttcgccggtgatgaggccggcataaacacagctacaactgcggcggcaaccgggacggacatgccatgcgatcacgtcccggtaacacctgcttcttcttcttcccctcttcactcacagtctcctcattcgccttccttcatggatcac

SEQ ID NO: 242 - protein, 452 aa, Zea mays
  GRMZM2G026926_T01
MDASSESGGAGGGRGGRRWKGKGVTPIQPRRTQLAPVMEDASAALLRPLKKIGRAPDRFQRSASSLSTTSSSAPPSPRSSAAGATSPASLSPPSARHMFPFAYEPSAPLGGAPRLELPPPWQHSPSVSQPASPQQQQQQQAQAPVQRQQQMISFGAPPQYQAQFLLPEGAQQQQHLLRYWSEALNLSPRGGQAAGVLPSLYQHLLRPPPPQKLYRGVRQRHWGKWVAEIRLPRNRTRLWLGTFDSAEDAAMAYDREAFKLRGENARLNFPDRFFGKGYAGGSGRTSATPAAAPTAAAASGSTSSSSPPQTPDDPSTQQTPPDAERSLDKQPQPPVATSSQLEGSSGEPTLADSGQMIHSPEPPAGSDWGPADEAWLNAWGPGSSFWDYDIDSTRGLFLHHGRFAGDEAGINTATTAAATGTDMPCDHVPVTPASSSSPLHSQSPHSPSFMDH

SEQ ID NO: 243 - DNA, 1290 bp, Setaria italica
  Si012169m
atggatgcgtcgagcgctagcggcgagagcggcggcggcggtggcgcggggggcggtcgtgggggcaggaggtggaagggcaaaggcggcgtcacgcccatacagccgcggcggcagctggcgccggtcatggaggacgcgtcggcggcgtcgctgcgcccgcacaagaagatcgggcgggcgccggaccgcttccagcggtccgcgtcgtcgctctcgacgacggcttcgtcgtcggccccgccttcccctcgcgccagcgccgcctcgccgacgccggcggagtcgtcgccgccctccgcacggcgcatcttcccgttcgcgtacgagccctcggcgccgccggtgggcggggccccgcggctgcagctcccgccgtggcagcactccagcgcgtcgcaaccggcgtcgccgcagcaggcgccgttgcagcgtcagcagatgatatcgttcggcgcgccgccgcagttccaggcgcagttctttttgccggatggctcgccgcagcaccagcagcagcatctgctgcggtactggagcgaggcgctgaacctgagcccgcgcggcggccaggccgcggccgtgctgccgtcgctgtaccagcacctggtgcgggccccgccgccgccgcagaagctgtaccgcggcgtgcggcagcggcactgggggaagtgggtggccgagatccggctgccgcggaaccgcacgcggctctggctcggcacgttcgactccgccgaggacgccgccatggcgtacgaccgcgaggccttcaagctccgcggcgagaacgcgcggctcaacttcccggaccggttcttcggcaagggccacgccgggggcagcggccgcaccagcgccacctccgcagccgccccgaccactgccgcggggtctggctcctcctcctcctcgtcgcctccacagactccggacgaggcaagcacacaacaaacgccaccgccgcacgcagaaggatcgttggacaagcagccacagcctccggtggcgacatcgtggcagcaagatgtcagctctaaaaccatgccagtctcgggtgaaatgattcacgcgccggtggctcatggcagcgagtggggtccggccgacgaggcttggttcaacgcgtgggggccaggaagttccttctgggactacgacatggacagcaacccaggcctctttctccatggtcgcttcgccggcgatgaggccaccatggagcactccaccgcacaagaaaccacagcggcagcggcagccgggacggacatgtcatgcgatcacgtc

SEQ ID NO: 244 - protein, 431 aa, Setaria italica
  Si012169m
MDASSASGESGGGGGAGGGRGGRRWKGKGGVTPIQPRRQLAPVMEDASAASLRPHKKIGRAPDRFQRSASSLSTTASSSAPPSPRASAASPTPAESSPPSARRIFPFAYEPSAPPVGGAPRLQLPPWQHSSASQPASPQQAPLQRQQMISFGAPPQFQAQFFLPDGSPQHQQQHLLRYWSEALNLSPRGGQAAAVLPSLYQHLVRAPPPPQKLYRGVRQRHWGKWVAEIRLPRNRTRLWLGTFDSAEDAAMAYDREAFKLRGENARLNFPDRFFGKGHAGGSGRTSATSAAAPTTAAGSGSSSSSSPPQTPDEASTQQTPPPHAEGSLDKQPQPPVATSWQQDVSSKTMPVSGEMIHAPVAHGSEWGPADEAWFNAWGPGSSFWDYDMDSNPGLFLHGRFAGDEATMEHSTAQETTAAAAAGTDMSCDHVP

SEQ ID NO: 245 - DNA, 1909 bp, Arabidopsis thaliana
  G1135
atggaaaaatatggattttgctataggatatatgcggagactcttctgactaaccagactggttggttgagtgagagctcagaaccaagttttatgcaggtactattacccgattcttggagttttgagtaatcacaatctcatgaacaagaagtattaattttcggtttttcttatatcctgtaggaaacaatctgtactagggttttgattcctataccgggaggactagtggagctctttgcgaccagacatgtatgtttatgtctcaataatgttaagtttatggttttttgtattgtggttgtttgtgatgatgtgtgcgcgtataggtcgctgaagatcagaacgtggtggattttgtaatgggacattgcaacatgttgatggacgattctgtaacgataaacatgatggtagcagacgaggtcgaatcgaagccgtacgggatgttatccggtgacatccagcaaaagggttccaaagaagaagatatgatgaatctcccttcgtcttacgatatctctgctgatcagatccgactcaatttcttgcctcagatgagtgattacgagacacaacacttgaagatgaagagtgattatcatcatcaagccttggggtatctcccagagaatggtaacaaggaaatgatgggtatgaacccatttaacacggtggaagaagatgggattccagtgattggagagcctagcttgcttgtgaatgaacagcaagttgttaacgataaggatatgaatgagaacggtagggtggattcagggtcggattgcagcgaccagattgatgatgaagatgatccaaagtacaagaagaagtcaggaaaaggatctcaagccaagaacctgatggctgagagacggaggaggaagaagctaaacgataggctttatgctctccggtcgcttgttcccaggataaccaaggtatcttggttttcgtctctgggtttacttcttggtttctgagttataatgcgttctctgaaactagtttttgtggcatggaagttggacagggcgtcgattcttggcgatgcaatcaactacgttaaggagttgcagaatgaggcaaaggagcttcaagacgagcttgaagagaactcagagactgaggatggatctaataggccacaaggagggatgagcctgaacgggacagtggtcactgggtttcacccggggctttcatgtaactccaacgttcctagcgtgaagcaagatgttgatcttgagaattccaatgataaaggacaagaaatggaggttagagcatcataacaagaaactaactctcacctttcttctaatctgaactctaaaatcaaaacctcatgatatcggtttatgttgggttgcggagtttcagccacaggtggacgtggctcagttagatggcagagagtttttcgtaaaggtgatttgcgaatacaaaccaggaggcttcacaaggctaatggaggcactggattctcttggactagaagtcacaaatgctaacacgactcgctacctcagcctggtctccaatgtcttcaaagtcgaggtatgatctaaaggacctgcggaatggagaaacaaaaaccaaagcaaaatatacaaaaactatatgtttctgttttcccatgttacagaaaaatgataacgagatggtccaagctgaacacgtaaggaactcgttgctggaaataacccggaacacatctagaggatggcaagatgatcagatggctacaggctctatgcaaaacgaaaagaacgaagttgattatcaacactatgatgatcaccagcatcacaatggtcatcatcacccatttgatcaccagatgaatcagagcgctcatcatcatcaccaccaccaacacatcaaccattaccacaaccaa

SEQ ID NO: 246 - protein, 630 aa, Arabidopsis thaliana
  G1135
MEVISCYLLLIILLLLLSSNFLSSFGTISWLSLVKFSPVTRFLRSLVFSENLVNHIERLMESNMQNLLEKLRPLVGARAWDYCVLWRLNEDQRFVKWMGCCCGGTELIAENGTEEFSYGGCRDVMFHHPRTKSCEFLSHLPASIPLDSGIYAETLLTNQTGWLSESSEPSFMQETICTRVLIPIPGGLVELFATRHVAEDQNVVDFVMGHCNMLMDDSVTINMMVADEVESKPYGMLSGDIQQKGSKEEDMMNLPSSYDISADQIRLNFLPQMSDYETQHLKMKSDYHHQALGYLPENGNKEMMGMNPFNTVEEDGIPVIGEPSLLVNEQQVVNDKDMNENGRVDSGSDCSDQIDDEDDPKYKKKSGKGSQAKNLMAERRRRKKLNDRLYALRSLVPRITKLDRASILGDAINYVKELQNEAKELQDELEENSETEDGSNRPQGGMSLNGTVVTGFHPGLSCNSNVPSVKQDVDLENSNDKGQEMEPQVDVAQLDGREFFVKVICEYKPGGFTRLMEALDSLGLEVTNANTTRYLSLVSNVFKVEKNDNEMVQAEHVRNSLLEITRNTSRGWQDDQMATGSMQNEKNEVDYQHYDDHQHHNGHHHPFDHQMNQSAHHHHHHQHINHYHNQ

SEQ ID NO: 247 - DNA, 1713 bp, Arabidopsis thaliana
  AT2G16910.1
atggagagtaatatgcaaaacttgttggagaaattgaggcctcttgtgggtgcaagggcttgggattattgtgttctttggagactaaacgaagaccaaaggtttgtgaagtggatgggatgttgttgtggtgggacagaactcatagcggagaatggaacagaagagtttagctacggaggttgtagggatgttatgtttcatcatcctcggaccaaatcttgtgaatttctttcccatcttccagcttccatacctcttgattccgggatatatgcggagactcttctgactaaccagactggttggttgagtgagagctcagaaccaagttttatgcaggaaacaatctgtactagggttttgattcctataccgggaggactagtggagctctttgcgaccagacatgtcgctgaagatcagaacgtggtggattttgtaatgggacattgcaacatgttgatggacgattctgtaacgataaacatgatggtagcagacgaggtcgaatcgaagccgtacgggatgttatccggtgacatccagcaaaagggttccaaagaagaagatatgatgaatctcccttcgtcttacgatatctctgctgatcagatccgactcaatttcttgcctcagatgagtgattacgagacacaacacttgaagatgaagagtgattatcatcatcaagccttggggtatctcccagagaatggtaacaaggaaatgatgggtatgaacccatttaacacggtggaagaagatgggattccagtgattggagagcctagcttgcttgtgaatgaacagcaagttgttaacgataaggatatgaatgagaacggtagggtggattcagggtcggattgcagcgaccagattgatgatgaagatgatccaaagtacaagaagaagtcaggaaaaggatctcaagccaagaacctgatggctgagagacggaggaggaagaagctaaacgataggctttatgctctccggtcgcttgttcccaggataaccaagttggacagggcgtcgattcttggcgatgcaatcaactacgttaaggagttgcagaatgaggcaaaggagcttcaagacgagcttgaagagaactcagagactgaggatggatctaataggccacaaggagggatgagcctgaacgggacagtggtcactgggtttcacccggggctttcatgtaactccaacgttcctagcgtgaagcaagatgttgatcttgagaattccaatgataaaggacaagaaatggagccacaggtggacgtggctcagttagatggcagagagtttttcgtaaaggtgatttgcgaatacaaaccaggaggcttcacaaggctaatggaggcactggattctcttggactagaagtcacaaatgctaacacgactcgctacctcagcctggtctccaatgtcttcaaagtcgagaaaaatgataacgagatggtccaagctgaacacgtaaggaactcgttgctggaaataacccggaacacatctagaggatggcaagatgatcagatggctacaggctctatgcaaaacgaaaagaacgaagttgattatcaacactatgatgatcaccagcatcacaatggtcatcatcacccatttgatcaccagatgaatcagagcgctcatcatcatcaccaccaccaacacatcaaccattaccacaaccaa

SEQ ID NO: 248 - protein, 571 aa, Arabidopsis thaliana
  AT2G16910.1
MESNMQNLLEKLRPLVGARAWDYCVLWRLNEDQRFVKWMGCCCGGTELIAENGTEEFSYGGCRDVMFHHPRTKSCEFLSHLPASIPLDSGIYAETLLTNQTGWLSESSEPSFMQETICTRVLIPIPGGLVELFATRHVAEDQNVVDFVMGHCNMLMDDSVTINMMVADEVESKPYGMLSGDIQQKGSKEEDMMNLPSSYDISADQIRLNFLPQMSDYETQHLKMKSDYHHQALGYLPENGNKEMMGMNPFNTVEEDGIPVIGEPSLLVNEQQVVNDKDMNENGRVDSGSDCSDQIDDEDDPKYKKKSGKGSQAKNLMAERRRRKKLNDRLYALRSLVPRITKLDRASILGDAINYVKELQNEAKELQDELEENSETEDGSNRPQGGMSLNGTVVTGFHPGLSCNSNVPSVKQDVDLENSNDKGQEMEPQVDVAQLDGREFFVKVICEYKPGGFTRLMEALDSLGLEVTNANTTRYLSLVSNVFKVEKNDNEMVQAEHVRNSLLEITRNTSRGWQDDQMATGSMQNEKNEVDYQHYDDHQHHNGHHHPFDHQMNQSAHHHHHHQHINHYHNQ

SEQ ID NO: 249 - DNA, 1725 bp, Populus trichocarpa
  POPTR_0009s13860.1
atgaatgtggtacaaaacctcatggagagactgaggcctcttgtgggtgtaaaaggctgggattattgtgttctttggaaactgagtgatgatcgaaggtatattgaattgatggattgttgttgcgctgggactgaggccactcaaaatggtgaagaccttcagtttcctgtttctgcagtccttccttgcagggatgtcatgtttcagcacccaggaactaaatcttgtgaacttcttgctcaacttccttcttcaatgcccctaaactcaggatttcatgcacagaccctgagctcaaacctgcctaggtggttaaacttctctagtagctcagattcaaatgttcttgaggaaacggttggaactagggccctgattccagtgccaggaggactaatggaactgttcattgctaaacaagtacctgaagatcaacatgtcatagatgttgtaacatctcaatgcaacttcctaatggaacaggaagccatgatcaactcaaccaacatggattcaagtttatcaaatattgatgtgaatgttatgagcgaaaaccaatcaaagccatttcttgctaatgaaaatgaacaagaggatcatcacagtttgaatattccatatgatacctcccttgatagactccacatgtctagttctccaatgaacaacttcatgcaccagttcaattacagcaccgacgaaaccaaaacaaaaggcgatctctttcaaggagtagagagtgggctacaagatatggatgatttgcagaagtccatgatggctaatgcagaaagcacgcagatgcaatatatggagtcaggtttaacaaccaaggatcaacatggaaatgacaaagaatcaataaaactagagaatgggccatcagcagaatattcacactcggattgcaacgatgatgaggatgatgcaaagtatcggaggaggactgggaaaggacctcaatcaaaaaaccttgttgctgagaggaaaaggaggaagaagcttaatgataggctctatgctctccggtccttggttcccaacatttcaaagctggatagggcttccatacttggagatgcgatcgaatttgtgaaagagcttcaaaaggaagcgaaagaactccaggatgagcttgaagagaattcagaagatgagggtgctaaaaacggtaacaacaacaatatgccaccagaaattctgaaccaaaatggagttaatcttggtgcatacaggtctgattatgctgtgaatggatttcatgtggaagcatcaggcattagtactgtttcaaaacaaaaccaagactcagaaaattctcacgacaagggacatcaaatggaggcgcaagtggaagttgctcagatagatgggaatgagttctttgttaaggtattctgtgagcacaagcctggagggtttgtgagattaatggaggctttggattctcttggcttagaagttacaaatgctaatgtgaccagcaatagaggcctggtttctaatgtcttaaaagtagagaaggacagtgaaatggttcaagcagactatgtaagggactctttgctggagttaacaagagacccaccaagagcgtggcctgaaatgcctaaagcatcagagatttgctgtagtgggatggactatcctcaccatgatcaccaccagcaccacctgcagaatggccacatgaattacaaccaccatcacctccaccacctt

SEQ ID NO: 250 - protein, 575 aa, Populus trichocarpa
  POPTR_0009s13860.1
MNVVQNLMERLRPLVGVKGWDYCVLWKLSDDRRYIELMDCCCAGTEATQNGEDLQFPVSAVLPCRDVMFQHPGTKSCELLAQLPSSMPLNSGFHAQTLSSNLPRWLNFSSSSDSNVLEETVGTRALIPVPGGLMELFIAKQVPEDQHVIDVVTSQCNFLMEQEAMINSTNMDSSLSNIDVNVMSENQSKPFLANENEQEDHHSLNIPYDTSLDRLHMSSSPMNNFMHQFNYSTDETKTKGDLFQGVESGLQDMDDLQKSMMANAESTQMQYMESGLTTKDQHGNDKESIKLENGPSAEYSHSDCNDDEDDAKYRRRTGKGPQSKNLVAERKRRKKLNDRLYALRSLVPNISKLDRASILGDAIEFVKELQKEAKELQDELEENSEDEGAKNGNNNNMPPEILNQNGVNLGAYRSDYAVNGFHVEASGISTVSKQNQDSENSHDKGHQMEAQVEVAQIDGNEFFVKVFCEHKPGGFVRLMEALDSLGLEVTNANVTSNRGLVSNVLKVEKDSEMVQADYVRDSLLELTRDPPRAWPEMPKASEICCSGMDYPHHDHHQHHLQNGHMNYNHHHLHHL

SEQ ID NO: 251 - DNA, 1635 bp, Vitis vinifera
  GSVIVT01013720001
atggtcaacatggtgcagagcctcaaggagaggctgaggcctcttgtgggattgaaaagctgggactactgtgttctttggaaactaagtgaagatcaaaggtttctggactggatggattgttgctgtgctggaagcgaaaacagtactcaaaatggtgaagaggagattctttttcctgtttccagtgtacttccttgcagggatgccatgttgcagcatccaagaaccaaatcttgtgatcttcttgcccaattgccttcttctatttccctagattctggcattcatggacagaccttgatttcaaaccaacccagatggctcaacttctgtaatagttcagattcaagcgttctcgaagaaacagttgggaccaggctcttgattccagtgctgggaggactaattgaactgtttgttgctaatcaagtagctgaggatcaacacgtagtaaacttcgtcacaacacagtgcaacataatcttgatggagcaggaagccatgatgaattcaagcaatattgatacaatcttctcagttaatgccaatgcaggcaatgcagatgaggaaaaggatcccaacaatcatttccaggcaacaatttccccagtaacagcattggagaacttgaatgatctgccatttgacatctcagttgaacgaatccgcctatgcagctctcccatgaacttcttgcagcaattcagttacacctctgagagtagcgtcaagaatgatatcttctttgaaggatccgatggctcatttctttcagagaaggagcagctgggtgatgataaggattcgagtactaaacaaatggcaaaccaagctgattcagtatcagactgcagtgatcagattgatgatgatgatgatttgaagtaccgaaggaggactggaaaagggactcaatcaaaaaacttggtcgctgagaggaggcgaaggaagaagcttaatgatagactctatgcgcttcgtgctttggttcccaaaatatctaagttggatagagcttcaattctgggtgatgcaatagaatttgtgaaggagttgcagaaacaagcaaaggatcttcaagatgagctggaagagcattcagacgatgaaggggggaagattaatgcaggcatcaacagcaaccataacaatgtccaatctgaaattctgaacaatgatggatcaggagttaacattgggctccctaagcaaaaccatgaaactgatcaaatcaacaatgacaaagcacagcagatggagccccaagtggaagtggctcagatagaaggcaatgagttcttcgttaaggtgttttgtgagcacaaggctggcgggtttgcgaggctgatggaggctctgagctctctaggcttggaagtgacaaatgcaaatgtaacaagctgcaaaggcctggtttctaatgtgttcaaagtagagaagagggacagtgagatggttcaagctgaccatgtcagggactccttgctcgagttgacaaaaagcccatctgaaaaatggtctgatcagatggcttaccctttggaaaatggcggaggcttggactttcaccaccaccactaccaccttcacagccatcttctcagttctcaccacctccaccaccatcagaat

SEQ ID NO: 252 - protein, 545 aa, Vitis vinifera
  GSVIVT01013720001
MVNMVQSLKERLRPLVGLKSWDYCVLWKLSEDQRFLDWMDCCCAGSENSTQNGEEEILFPVSSVLPCRDAMLQHPRTKSCDLLAQLPSSISLDSGIHGQTLISNQPRWLNFCNSSDSSVLEETVGTRLLIPVLGGLIELFVANQVAEDQHVVNFVTTQCNIILMEQEAMMNSSNIDTIFSVNANAGNADEEKDPNNHFQATISPVTALENLNDLPFDISVERIRLCSSPMNFLQQFSYTSESSVKNDIFFEGSDGSFLSEKEQLGDDKDSSTKQMANQADSVSDCSDQIDDDDDLKYRRRTGKGTQSKNLVAERRRRKKLNDRLYALRALVPKISKLDRASILGDAIEFVKELQKQAKDLQDELEEHSDDEGGKINAGINSNHNNVQSEILNNDGSGVNIGLPKQNHETDQINNDKAQQMEPQVEVAQIEGNEFFVKVFCEHKAGGFARLMEALSSLGLEVTNANVTSCKGLVSNVFKVEKRDSEMVQADHVRDSLLELTKSPSEKWSDQMAYPLENGGGLDFHHHHYHLHSHLLSSHHLHHHQN

SEQ ID NO: 253 - DNA, 1719 bp, Vitis vinifera
  GSVIVT01024008001
atgtttcagaatcaggttaacagaacttattttgataacagagaacattctagcccagttacaagtaggttttttgaagtgggtatgatgttaattgcaggagaaacgatcaatatggtgcagagcctcatggagaggctaaggcctcttgtgggattgaaaagcagggactgggactactgtgttctttggaaactaagtgaagatcaaaggtttctggactggatggactgttgctgcgccggaggaggtgaaaacagtactcaaaatggtggagaagagcatctttttcctgtttccagtgtccttccttgcagggatgccatgtcgcagcacccaagaaccaaatcttgtgatcttcttgcccaactgccttcttccatctccctagattctgggattcatggacagaccttgatctcaaaccaacccagatggctcaacttctgtaatagctcagattcaagcattcttgaagaaacagttgggactgggctcctgattccagttctgggaggactaattgagctgtttgttgctaaacaagtagctgaggatcaacatgtaatcaactttgttacaacacagtgccacatgatctcaatggagcaggaagccatgatgaattcaagcaatatcaattcaatcttctcggttaatgtcaatggaggcaatgcagatgagaatcaaaaggatcccaacaatcatttccaggcaccaatttccccagtaacagcaatggaggacttgaatgatctgccaatctcagtcgaccaaatccgcctatgcagctctcccatgaacttcttgcagcaattcagttacacctctgagagtagtatcaagaatgatcagctgggtgatgatcataaggatttgagtgctaaaagaacagcgaaccaagctgattcagtttcagactgcagtgatcagattgatgatgatgatgatttaaagttccaaaggaggacagggaaaggggctcaatcgaaaaacatcgatgctgagaggaggcgaaggaagaagcttaatgataggctctatgcgcttcgttctttggttcccaaaatatcaaagttggatagagcttcaattctgggtgatgcaatagaatttgtgaaggagttgcagaagcaagcgaaggatctgcaagatgagcttgaagagaattcagaggacgaagtaaacatcgggcctaaaactgaaaatgaagaaactcaaaaccggtttcttatgggagcagcaggcaatggcattgccgccagtgcctgcaggccgccatcagcaaagcagaaccatgaaaccgaccaaatcactgatgacaaagcacagcagatggagccccaagtggaggtggctcagatagaagggaatgacttctttgtcaaggtgttttgcgagcataaggcgggcgggtttgtgaggctgatggaggctctgagctctttaggcttggaagtgactaatgcaaatgtaacaagctgcaaaggcctggtttccaatctgttcaaagtagagaaaagggacagtgagatggtccaagctgaccatgttagggactccttgctcgagttaacgaaaaacccatctgaaaaatggcatggtcagatggcttacgcttcggaaaatggtggtggcttggacttccacaaccatcaccaccaccatcacctccacagccatctcctcagttcccatcacctccaccaccttcagaat

SEQ ID NO: 254 - protein, 573 aa, Vitis vinifera
  GSVIVT01024008001
MFQNQVNRTYFDNREHSSPVTSRFFEVGMMLIAGETINMVQSLMERLRPLVGLKSRDWDYCVLWKLSEDQRFLDWMDCCCAGGGENSTQNGGEEHLFPVSSVLPCRDAMSQHPRTKSCDLLAQLPSSISLDSGIHGQTLISNQPRWLNFCNSSDSSILEETVGTGLLIPVLGGLIELFVAKQVAEDQHVINFVTTQCHMISMEQEAMMNSSNINSIFSVNVNGGNADENQKDPNNHFQAPISPVTAMEDLNDLPISVDQIRLCSSPMNFLQQFSYTSESSIKNDQLGDDHKDLSAKRTANQADSVSDCSDQIDDDDDLKFQRRTGKGAQSKNIDAERRRRKKLNDRLYALRSLVPKISKLDRASILGDAIEFVKELQKQAKDLQDELEENSEDEVNIGPKTENEETQNRFLMGAAGNGIAASACRPPSAKQNHETDQITDDKAQQMEPQVEVAQIEGNDFFVKVFCEHKAGGFVRLMEALSSLGLEVTNANVTSCKGLVSNLFKVEKRDSEMVQADHVRDSLLELTKNPSEKWHGQMAYASENGGGLDFHNHHHHHHLHSHLLSSHHLHHLQN

SEQ ID NO: 255 - DNA, 1713 bp, Glycine max
  Glyma10g42830.1
atgaacatcagcatgcaacacttagtagagagactaagacccctcgtgggtttgaacggatgggactattgcatctactggaaattgagtgaagaccaaaggtttcttgagtggttgggatgctgttgtgctggcactgaaagcaatcaaaatgctggggaagaacatcttttccctgtctcttctgtggcttcatgcagagatatcacttatccacaccccagaacaaagccctgtgatcttctttcacagctttccacttgcatacccatagataattctgggattcatgcacagaccctattaacaaaccaacccaactgggtgaactattccaatggcatggatcctaacattttggaagaaacaattgggacccaggttttgatttcggtgccgggtggactagttgagctgtttgtaactaaacaagtgtctgaagatcatcaactaatagattttgtgacaaaccagtgcattgaagccgtgaaccactcaatgagcttcaacattgacgtgagcaacatgcaatcaaacccacttatacaagatgaaaacgaagggaacaacaacaggaacaataatcacttattccatccatcagaacatgtcatcactgatatggaccaccgcaatattggtctgtgtaattctcaactgaacttcatgcagcagttcaactacaaccagcacaacagaatgaagagcgatgctgctttctctgaagaataccaagctggtaattccttccttcacgacgagcaaaccaacccagaagatgatcaggagcctgggcatgagcatgacacgtatcagaaaagcctcatgacaacagattcacaatacgtggaggcaaaagatcagaagcaagaggaagacaaggacttgatgaaaaacgttgttggcagatcagattcaatgtcagattgcagtgaccagaacgaagaagaggaattagatggaaagtataggaggaggaatggaaaagggaaccaatccaagaaccttgtggctgaaagaaagagaaggaagaaactcaatgataggctatataaccttcgttctttggttcctaggatctctaagctggatagggcatccattcttggagatgccattgagtatgtgaaggatttgcagaagcaagtgaaggagctccaagatgagcttgaggagaatgcagacactgaaagcaactgcatgaatattggtgtaggtgctgaacttgggccaaatgctgaacatgataaggcccaaactgggttgcatgtgggaacatcagggaatggatatgtctccaaacaaaagcaggaagacatgcatgagtgtgcaaatttgcttattgaaatgcagccgcaagtggaagtggctctgatagatgagaatgagtattttgtgaaggttttctgtgagcacaggcctggtgggtttgtgaaattgatggaagcgttgaacactattggcatggatgtagtgcatgccacggtaaccagccacacgggactcgtctcaaatgtttttaaagtggaaaaaaaggataatgaaacggttgaggctgaagatgtaagagactcactgctagagcttacgcggaaccgttatagagggtggactcatgagatgacagcaacgccggaaaatggggtgggaagggatcaacatcaacttcacaaccaccagcagataggtgcctacccgcaccagtttcatagt

SEQ ID NO: 256 - protein, 571 aa, Glycine max
  Glyma10g42830.1
MNISMQHLVERLRPLVGLNGWDYCIYWKLSEDQRFLEWLGCCCAGTESNQNAGEEHLFPVSSVASCRDITYPHPRTKPCDLLSQLSTCIPIDNSGIHAQTLLTNQPNWVNYSNGMDPNILEETIGTQVLISVPGGLVELFVTKQVSEDHQLIDFVTNQCIEAVNHSMSFNIDVSNMQSNPLIQDENEGNNNRNNNHLFHPSEHVITDMDHRNIGLCNSQLNFMQQFNYNQHNRMKSDAAFSEEYQAGNSFLHDEQTNPEDDQEPGHEHDTYQKSLMTTDSQYVEAKDQKQEEDKDLMKNVVGRSDSMSDCSDQNEEEELDGKYRRRNGKGNQSKNLVAERKRRKKLNDRLYNLRSLVPRISKLDRASILGDAIEYVKDLQKQVKELQDELEENADTESNCMNIGVGAELGPNAEHDKAQTGLHVGTSGNGYVSKQKQEDMHECANLLIEMQPQVEVALIDENEYFVKVFCEHRPGGFVKLMEALNTIGMDVVHATVTSHTGLVSNVFKVEKKDNETVEAEDVRDSLLELTRNRYRGWTHEMTATPENGVGRDQHQLHNHQQIGAYPHQFHS

SEQ ID NO: 257 - DNA, 1614 bp, Glycine max
  Glyma20g24170.1
atgaacatcatcatgcaaaacttagtagagagactaagacccctcgtgggtttgaacggatgggactattgtatctactggaaattgagtgaagaccaaaggtttcttgagtggttgggatgctgttgtgctggcactgaaagcaatcaaaatgctggggaagaacatattttccctgtctcttctgtggcctcatgcagggatagtacatatccacaccccagaacaaagccctgcgatcttctttcacagctttccacttccatacccatagataattctgggattcatgcacagaccctattaacaaaccaacccaactgggtgaactattccaatggcatggatcctaacatcttggaagaaacaattgggacccaggttttgatttcggtgccaggtggactagttgaactgtttgtaactaaacaagtgcctgaagatcatcaactaatagattatgtcataaaccagtgcattgaagccgtgaaccactcaatgagcttccacattgacgagaattcaatgagcaacatgcaatcaaacccacttataggcgatgaaaatgaagggaacaacaacagcagggacacttccacccttcagaacatgtcatcacaatggacctccgcagtattggtctctggttcctttcttcacgacaagcaaaccaaccaagaagatcaggagcatgagcatgagcatgacacgtatcagaaaagcctcatgacaacaacggattcacaatacgaggacaaggacttgctgaaaaacgttgttggtagatcagattcaatgtcagattgcagtgaccagaacgaagaagaggaagatggaaagtataggaggaggaatgggaaagggaaccaatccaagaaccttgtggctgagaggaagagaaggaagaagctcaatgataggttatataaccttcgttctttggttcctaggatctctaagctggatagggcatccattcttggagatgccattgagtatgtgaaggatttgcagaagcaagtgaaggagctccaagatgagcttgaggagaatgcagacactgaaagcaactgcatgaattgtgtaagtgaacttgggccaaatgctgaacatgataaggcccaaactgggttgcatgtgggaacatcagggaatggctatgtctccaaacaaaagcaggaagccaaatttattaaattacgagaaagaattaataaaattaggtacattgcaaatttgcttaatgaaatgcagccgcaagtggaagtggctctgatagatgggaatgagtattttgtgaaggtgttctgtgagcacaggcctgatgggtttgtgaaactgatggaggcattgaacactattggcatggatgtagtgcatgccacggtaaccagccacacgggactcgtgtcaaatgtttttaaagtggaaaaaaaggatagtgaaacggttgaagctgaagatgtaagagactcactgctagagcttatgcggaaccgttacagagggtggactcatgagatgacagcaacgtcgggaaatagtgtggaaagcgatcaacatcaactccacaaccacaaccagatgggtgcctacccgcacgagtttcatagt

SEQ ID NO: 258 - protein, 538 aa, Glycine max
  Glyma20g24170.1
MNIIMQNLVERLRPLVGLNGWDYCIYWKLSEDQRFLEWLGCCCAGTESNQNAGEEHIFPVSSVASCRDSTYPHPRTKPCDLLSQLSTSIPIDNSGIHAQTLLTNQPNWVNYSNGMDPNILEETIGTQVLISVPGGLVELFVTKQVPEDHQLIDYVINQCIEAVNHSMSFHIDENSMSNMQSNPLIGDENEGNNNSRDTSTLQNMSSQWTSAVLVSGSFLHDKQTNQEDQEHEHEHDTYQKSLMTTTDSQYEDKDLLKNVVGRSDSMSDCSDQNEEEEDGKYRRRNGKGNQSKNLVAERKRRKKLNDRLYNLRSLVPRISKLDRASILGDAIEYVKDLQKQVKELQDELEENADTESNCMNCVSELGPNAEHDKAQTGLHVGTSGNGYVSKQKQEAKFIKLRERINKIRYIANLLNEMQPQVEVALIDGNEYFVKVFCEHRPDGFVKLMEALNTIGMDVVHATVTSHTGLVSNVFKVEKKDSETVEAEDVRDSLLELMRNRYRGWTHEMTATSGNSVESDQHQLHNHNQMGAYPHEFHS

SEQ ID NO: 259 - DNA, 1650 bp, Eucalyptus grandis
  Eucgr.G01783.1
atgattattgtccatactccgatggaaagacttcgaccccttgtgggctcgaacggctgggacttctgtgttctctggaaattgagtgaagatcaaagactgatagagtggattgactgttgctgcgctggagctgaacacaacgaaattggaaatgaagaattcgattttccagtgtctccatgtagggatgtcatgtttcagcatccaagaagaaccaaagcttgcgaactacttgctcagatgccctcttctgtgcccctagagtccgggatttatgcgcatgccttcatgtcataccaaccaaagtggcttaacttcgccagcagctccgactcaaaagcagaagaaggtacaattgggaccaaggtccttgtaccgtttactggaggtttggttgagcttttcgttactaaacaagtaccagaagatcaacaaatcataggctttatcacatcccagttctccattccgtttgaggccgattccttatcctcagtctgtatggagacaaatttctcgataataccgaatgctttgaatgatctgcagtccaggccacagatgatagacccaaatgaccacactgattcgccggcacaactgcctgaaaatctgaacctgcacgatgcttccagtgacagaatccaccagtatgaggcgaccatcggaggatcgtatgacacttttgtagctaacgaggaaatgaatccttccaacaagttgtcagcaatggacggatttcaagagatggatggagcggaacaaatgaatgtggaccttacagaacaagtgaacacagagtggcaagggaatgatgaggaaacagtaaaaccagagaatggcgcgacaaagtccacatctgattgcagcgatcagaacgaggaggatgatgagaggaatgggaagcagcctcactcgaagaaccttcaagcagagaggaggaggaggaagaagctcaatgaccgcctctacaatcttcgctcattagtcccaaaaatttccaagctggatagagcttcaatacttggggatgcaatcgaatacataatggagctgcagaagcaagctaaggaactccaagatgagctcgaagagcaatcggatgtggaagaccccaggaactccggcagcagcagcaacttcaccgttggccaacccgagtttttcgacattgggttcctgtcagcatcagagaaagtggcatttacttatcagctgccaggaaacactcaaggagatggatccaccaggagaaaccgtgagtcagagacagcatatgacaagcaacaacgcatggagccgcaggtggaagttcggcagatggacgagaatgagttcttcatcaaggtgttcggggagcaccggcctggtggttttgtgagattgatggaggctttggactccataggcctcgaagtgaccaatgcaaatgtgaccagattcctaagccttgtctcaaacgttttcactgttgagaagaaggacagcgagctggtggaagccgatctcctgaaggactctctgctggagctgacgaggaatcccacaagtgggtggccagggctgagcaaagcggtggagactggcagtgccaggaattaccatggccatcagcatcattaccacctcctgcacaaccatctcttc

SEQ ID NO: 260 - protein, 550 aa, Eucalyptus grandis
  Eucgr.G01783.1
MIIVHTPMERLRPLVGSNGWDFCVLWKLSEDQRLIEWIDCCCAGAEHNEIGNEEFDFPVSPCRDVMFQHPRRTKACELLAQMPSSVPLESGIYAHAFMSYQPKWLNFASSSDSKAEEGTIGTKVLVPFTGGLVELFVTKQVPEDQQIIGFITSQFSIPFEADSLSSVCMETNFSIIPNALNDLQSRPQMIDPNDHTDSPAQLPENLNLHDASSDRIHQYEATIGGSYDTFVANEEMNPSNKLSAMDGFQEMDGAEQMNVDLTEQVNTEWQGNDEETVKPENGATKSTSDCSDQNEEDDERNGKQPHSKNLQAERRRRKKLNDRLYNLRSLVPKISKLDRASILGDAIEYIMELQKQAKELQDELEEQSDVEDPRNSGSSSNFTVGQPEFFDIGFLSASEKVAFTYQLPGNTQGDGSTRRNRESETAYDKQQRMEPQVEVRQMDENEFFIKVFGEHRPGGFVRLMEALDSIGLEVTNANVTRFLSLVSNVFTVEKKDSELVEADLLKDSLLELTRNPTSGWPGLSKAVETGSARNYHGHQHHYHLLHNHLF

SEQ ID NO: 261 - DNA, 1737 bp, Citrus clementina
  clementine0.9_030440m
atgacagttgttcaaaccctaatggatagactgaggccactagtgggcctgaaaggctgggactactgcgttctttggaaattgagtgatgatcaaaggttaattaattgttgctgtgctggaattgagggcacacaaaatgatgatggagacgaacttcactttccagtttctccatttcttccttgcagggatgttatatttccacatccaagaaccaaatcttgtgagcttctttctcaacttccttcttcaatgcctcttgactccgggatttacgcgcaaagtttgatatcaaaccaacctcgatggctaaacttctctaatagcgctgatttagaagttatggaggaaacactttggactagggttttgattccaataatgggaggattgattgagctatttgctaccaaagaagtaagtgaagaaccacatgtgattgattttatcatagctcaatgtaacatatcaatggagcaggatcctatgaatatgaacacaagctgctatttagataatgctagttcctcagttaatgtgcacgccatggcattggaaaacagtgatgtgccatatgagctctccgttgatcgaattcgcatctgcagtggttgtacttctccagtgaatttcttgcagcaatttggttacagcagcagctctaaaaatgttaaacgtcacagaaacgatgtgttctttgaagggtcgcgtgatgattcaactcatcaaaatggaattcaagagatggataatgcatcaaacatgaacatgcaatttatggagcctaatatgggaaacaaggagctgcaacaagggaattatgatgatcttaataaggacttgatcaaaccggatcagaataataataataataacaatggacggtcagattctatctcggattgtagtgatcagattgatgatctggaagatgacgtaaagtacaggccgcggagaaatgggaaggagcctcagtctaagaatcttgtggctgagaggaagaggaggaagaagctcaatgatagactttatgcacttcgagctttggttcccattattactaaactggatagggctaccattcttgtggatgcaattgaatatgtgaagcagttgcaaaagcaagagaaagagctaaaagaggagctagaggagaactcggatgatgatggagctgcaaagaatgatgatatgggcatcagtgttaataaccacaacgctgtgaaatcagagagtttaacccaaaatgggacgaattttggtcccaaaactgaacctaagcagtgtcatatgggcaatggtcgtaaacaggatcaggattcggaaaatactattgataaaggacaacaaatggaggtgcaagttgaagtggcgcaattaaatgggaatgagttctttattaaggtgttttgtgagcataagcctggtgggtttgtgagattaatggaggctttgaattctttgggactggaagtgacaaatgcgaacgtaactagccgcacaggacttgtgtctaatgttttcaatgtgaagaaaagagataatgagatggttcaagctgatcatgtaagggactcattgctggagctcacgagaaacccggcaagagagtggattgagaatgtggctaaagcttcagatagtacggtcaataatgggattaattatcatcaccatgagcagcaccttcacagtcaccatatgagtacccatcaccaccatcttcatcataat

SEQ ID NO: 262 - protein, 579 aa, Citrus clementina
  clementine0.9_030440m
MTVVQTLMDRLRPLVGLKGWDYCVLWKLSDDQRLINCCCAGIEGTQNDDGDELHFPVSPFLPCRDVIFPHPRTKSCELLSQLPSSMPLDSGIYAQSLISNQPRWLNFSNSADLEVMEETLWTRVLIPIMGGLIELFATKEVSEEPHVIDFIIAQCNISMEQDPMNMNTSCYLDNASSSVNVHAMALENSDVPYELSVDRIRICSGCTSPVNFLQQFGYSSSSKNVKRHRNDVFFEGSRDDSTHQNGIQEMDNASNMNMQFMEPNMGNKELQQGNYDDLNKDLIKPDQNNNNNNNGRSDSISDCSDQIDDLEDDVKYRPRRNGKEPQSKNLVAERKRRKKLNDRLYALRALVPIITKLDRATILVDAIEYVKQLQKQEKELKEELEENSDDDGAAKNDDMGISVNNHNAVKSESLTQNGTNFGPKTEPKQCHMGNGRKQDQDSENTIDKGQQMEVQVEVAQLNGNEFFIKVFCEHKPGGFVRLMEALNSLGLEVTNANVTSRTGLVSNVFNVKKRDNEMVQADHVRDSLLELTRNPAREWIENVAKASDSTVNNGINYHHHEQHLHSHHMSTHHHHLHHN

SEQ ID NO: 263 - DNA, 1656 bp, Brachypodium distachyon
  Bradi3g01910.1
atgggaggaggagagcatcagctggagcaccacagcatcgtcagctctgctgctgctgctgctgctgctgccgttcatggccatggcggtggcggcggcacggtggaggcggcgctgaggccgctcgtgggcgccgacggctgggattactgcatctactggcgcctctcccctgaccagaggttcttggagatgacggggttctgctgcagcggcgagttcgaggcgctcggcgacctgccttcctccatcccgctcgactcctcctccatcgggatgcacgcgcaggcgctgctgtcgaaccagccaatctggcagagctgctccggcgacatggcgccgcaggtgcaggatactgccggcggcgagaagacgcggctcctcgtccccgtcgccggcggcctcgtggagctcttcgcctccagatacatggcggaggagcaggagatggcggagctggtgatggcgcagtgcggcggcggccatggctggcagcttcagcagcagcagccggctatggcggcggcggaggaggagcagttctacgcggcgacgtcggtggcgtcgctcaacctgttcgacggcggcggcggcggcgccggcggagacgaccagttcctggctgccggcgccggggaagacgacggtggcgctgcggcgtggggggtcgcggccgggactagcagcgaggcggcgcacgagcagcagcagctgtactccggcggtgcggcggcggcggcccgggcggagtccgggtcggagggcagcgagctgcagggcgacgacgacgacgtggacggcggggtccagaggaaggacggcggccatggcggcggcggcggcaagcggcagcagtgcaagaacctgatggccgagcgcaagcgccgcaagaagctcaacgaccgcctctacaagctccgctccctcgtccccaacatcaccaagatggaccgggcatcgatcctgggggacgcgatcgactacatcgtggggctgcagaagcaggtcaaggatctccaggacgagctcgaggaagaagacaacccaaataaccccgacgtgctcaccatggacgaccacccgccgccggggctcgacaacgacgaggcctcacccccgccgccgcagaagcgtgcccgggcgccggcggcggatccggaggaggaggaggagaagggagagcaggaggagcaggagcaggacatggagccgcaggtggaggtccggcaggtgggcggcggcggggaggagttcttcctgcaggtgctctgctcgcacaagcccggccgcttcgtgcgcatcatggacgagatcgccgccctgggcctacaggtcaccaacgtcaacgtcacctcctacaacaagctcgtcctcaacgtcttccgcgccgtcatgagggagaacgaggcggcggtgccggcggacagggtgagggactcgctgctggaggtgaccagggagatgtacggcgctggcggcgtgtggccggcggcgatggcgccgctgccggcgatggaggcgccgatgatggtgatggcggccgaggcgaagctcgacggcggcggcgaagcgggggagcaccattaccagctgcagcagcagcaattgcttggcgggtatcaccagcagcagcatctgtactacctcggtctcgat

SEQ ID NO: 264 - protein, 552 aa, Brachypodium distachyon
  Bradi3g01910.1
MGGGEHQLEHHSIVSSAAAAAAAAVHGHGGGGGTVEAALRPLVGADGWDYCIYWRLSPDQRFLEMTGFCCSGEFEALGDLPSSIPLDSSSIGMHAQALLSNQPIWQSCSGDMAPQVQDTAGGEKTRLLVPVAGGLVELFASRYMAEEQEMAELVMAQCGGGHGWQLQQQQPAMAAAEEEQFYAATSVASLNLFDGGGGGAGGDDQFLAAGAGEDDGGAAAWGVAAGTSSEAAHEQQQLYSGGAAAAARAESGSEGSELQGDDDDVDGGVQRKDGGHGGGGGKRQQCKNLMAERKRRKKLNDRLYKLRSLVPNITKMDRASILGDAIDYIVGLQKQVKDLQDELEEEDNPNNPDVLTMDDHPPPGLDNDEASPPPPQKRARAPAADPEEEEEKGEQEEQEQDMEPQVEVRQVGGGGEEFFLQVLCSHKPGRFVRIMDEIAALGLQVTNVNVTSYNKLVLNVFRAVMRENEAAVPADRVRDSLLEVTREMYGAGGVWPAAMAPLPAMEAPMMVMAAEAKLDGGGEAGEHHYQLQQQQLLGGYHQQQHLYYLGLD

SEQ ID NO: 265 - DNA, 1788 bp, Solanum lycopersicum
  Solyc08g062780.1.1
atggagaggcttaggcctattatgagcttaaaaggctgggattactgtgttttatggaagttgagtgaagatcaaaggtttcttgaatggatttgttgctgctgtggcggagctgagaaaaatatgcatggctgtggacaagagatattttttcctgattcttctacttcaacttgcagagatgttatgtttcagcatccaacaacaactgcttgtaatttactggctcaggtcccgccttctctggcgctagactgcggagtttatgcacagaccttactatctaatcaagcaaaatggatgaactttgttcctttctcggaatcaaatatctctaatgaaataatgggaactagagctctgattccatctcctcttggattgctcgagttgttcagtacgcaacaactagcagaagatgagaaagtgatagaatttgtctcagctcaatgcaatatctacttggagcagcaagctatgatgaattcaactttctcaaatggagttgaagagaacaacacatcaaagcctttcccaacagaaggagaaagagacagagacgatcatataaaagattcccaaaatcattacaaacagagagtctcccctgcagctacatcagatcacttgtcatttgatttcccacttaaacgaaaacaattggattcttgttcgatgaacttccttccaccgttcagtacttatagcacaccagaagtggataacaacacaggagggaacatgttgtttgatcagagcacaagtgatatgacacatttttcggagaataggtacatgagtgagatggatgcttatttacagaagcaaatgatgagaagcagtagtactcaagctggaattgatgatgaatcaatcaaacatgataacggaagatcaaattcgggatctgatagtgatcaaaatgaggaagaagatgatcccaagtatagaaggagaaatggaaaaggtcctcaatccaagaatcttatggctgaaaggaaaagaaggaagaaactaaatgaaaggctctatgctcttagagctttggttcccaaaatctccaagttggatagagcatctatcctcggagatgctattgaatatgtgatggaattggaaaagcaagtgaaagatctgcagcttgaggttgaagaacattcagatgacgacggtactggtggaggaaggaattcggaccagattcaccccgtagttttaagccataatggaactaaaaacaggcctaaatcagataacggaaaacttacaaatggaagccaaagagaaatatcaactaattctaatggcagcactgacccttccagaaaaaatcaagatgtagaagagaacgacaaattgcagcaaatggagccacaagtggaagttgctcaattagatgggaatgagttctttgtgaaggtgtttcgtgaacacaaggctggtggatttgtgaggactttggaggctttgaactcattgggcttggaagttaccaatgttaatgcaactaggcatacttgtttggtatcaagtatcttcaaagttgaacagaaaagggataatgaaatggttcaagctgatcatgtgagggacaccttgctagagctgacaagaaaccctagtagaggttggtctgaaatgggtagagcatcatcagataatataaataataataatgcaaatggcactacagattatcatcaacatcaacttcatgatcatcacctagacaataataatcaacataagcaaaccaattctcatcacttccatacacaccaccatcac

SEQ ID NO: 266 - protein, 596 aa, Solanum lycopersicum
  Solyc08g062780.1.1
MERLRPIMSLKGWDYCVLWKLSEDQRFLEWICCCCGGAEKNMHGCGQEIFFPDSSTSTCRDVMFQHPTTTACNLLAQVPPSLALDCGVYAQTLLSNQAKWMNFVPFSESNISNEIMGTRALIPSPLGLLELFSTQQLAEDEKVIEFVSAQCNIYLEQQAMMNSTFSNGVEENNTSKPFPTEGERDRDDHIKDSQNHYKQRVSPAATSDHLSFDFPLKRKQLDSCSMNFLPPFSTYSTPEVDNNTGGNMLFDQSTSDMTHFSENRYMSEMDAYLQKQMMRSSSTQAGIDDESIKHDNGRSNSGSDSDQNEEEDDPKYRRRNGKGPQSKNLMAERKRRKKLNERLYALRALVPKISKLDRASILGDAIEYVMELEKQVKDLQLEVEEHSDDDGTGGGRNSDQIHPVVLSHNGTKNRPKSDNGKLTNGSQREISTNSNGSTDPSRKNQDVEENDKLQQMEPQVEVAQLDGNEFFVKVFREHKAGGFVRTLEALNSLGLEVTNVNATRHTCLVSSIFKVEQKRDNEMVQADHVRDTLLELTRNPSRGWSEMGRASSDNINNNNANGTTDYHQHQLHDHHLDNNNQHKQTNSHHFHTHHHH

SEQ ID NO: 267 - DNA, 1707 bp, Brachypodium distachyon
  Bradi3g01901.1
atgggagtagagcatcagcagcaccacagcatagtcggcagctctgctgctgctgccgttaatggccatggcggcggcggcggaggaggagggggaggcgccacggtggaggcggtgctgaggccgctcgtcggcgccgacagctgggactactgcatctactggcgcctctcccctgaccagagtttcttggagatgacggggttctgctgcagcggcgagttcgaggcgcaggtggcggctctcggcgacctgccttcctccatcccgctcgactcctccatcgggatacactcgcaggcgctgctgtcgaaccagccgatctggcagagctactccagcgacgtggcgcagacgcatgatactgccggcggcaacggtggcggcgagaagacgcggctcctcgtccccgtcgccggcggcctcgtggagctctttgcgtccagatatatggcggaggagcaggagatggcggagatggtcatggtgcagtgcggcggcggacatggctggcagctgcagcagccggctacggcggcggaggaccagttctacgcagctacgtcggtggcgtctctcaacctgttcgacagcggcggcggcgaggaccagttcttggcgccggctgccgaagccggggaagacggtggcgctgcgtcgtgggggttcgcggccgggaacagcgagccgtcggcggcggtgcacgagcagctgtactccggtggggtggcggcgagggcggagtccggttcggagggcagcgagctgcagggcgacgacgacgtcgatggcgaggtccagaggggcgggaaggacggcggcactggcggagggaagcggcagcagtgcaagaacctaatggccgagcgcaaccgccgcaagaagctcaacgaccgcctctacaagctccgctccctcgtccccaacatcaccaagatggaccgggcggcgatcctgggggacgcgatcgactacatcgtggggttgcagaagcaggtgaaggagctgcaagacgagctcgaggaagaagaaaacccaaaccccaacaacggcatcatggcccccgacgtgctcaccatggacgaccacccgccgccggggctggataacgacgacgtgtcccccccgccgccgcagccacccctctgcaagaagcgggcccgggcggccgcggcggcggcggcgggggaggatcaggaggagaaggacgacgacaagggtggcgaccaagaccaggacatggagccgcaggtggaggtccggcaggtggacggcagcgacgagttcttcctgcaggtgctctgctcgcacaagtccggccgcttcgtccgcatcatggacgagatcgccgccctggggctccaggtcaccaacgtcaacgtcacctcctacaacaagctcgtcctcaacgtcttccgcgccgtcatgagggagaacgaggcggcggtgccggtggacagggtgagggactcgctgctggaggcgaccagggagatgtacggcgctggcggctgcgtgtggccggtggcagcgatggctccgccgccgctgacgacgagggagacgccgacgacgacgatgatgatggcggaggtggcgaagctctacggcggccaagcgggggagcaccattaccacctgcagcagcagcagcaccaagagcttggcgggtatcaccagcatcatctgcactacctcggtctcgac

SEQ ID NO: 268 - protein, 569 aa, Brachypodium distachyon
  Bradi3g01901.1
MGVEHQQHHSIVGSSAAAAVNGHGGGGGGGGGGATVEAVLRPLVGADSWDYCIYWRLSPDQSFLEMTGFCCSGEFEAQVAALGDLPSSIPLDSSIGIHSQALLSNQPIWQSYSSDVAQTHDTAGGNGGGEKTRLLVPVAGGLVELFASRYMAEEQEMAEMVMVQCGGGHGWQLQQPATAAEDQFYAATSVASLNLFDSGGGEDQFLAPAAEAGEDGGAASWGFAAGNSEPSAAVHEQLYSGGVAARAESGSEGSELQGDDDVDGEVQRGGKDGGTGGGKRQQCKNLMAERNRRKKLNDRLYKLRSLVPNITKMDRAAILGDAIDYIVGLQKQVKELQDELEEEENPNPNNGIMAPDVLTMDDHPPPGLDNDDVSPPPPQPPLCKKRARAAAAAAAGEDQEEKDDDKGGDQDQDMEPQVEVRQVDGSDEFFLQVLCSHKSGRFVRIMDEIAALGLQVTNVNVTSYNKLVLNVFRAVMRENEAAVPVDRVRDSLLEATREMYGAGGCVWPVAAMAPPPLTTRETPTTTMMMAEVAKLYGGQAGEHHYHLQQQQHQELGGYHQHHLHYLGLD

SEQ ID NO: 269 - DNA, 1599 bp, Setaria italica
  Si019518m
atgggagggggagatcaccggtgcatggccgccacggcggccgcttctgccggggatggaggcggcagcgtggaggctgcgctgaggcctcttgttggtgcaaacgcctgggactactgcatctactggaggctgtctcctgatcagaggttcttggagatggctgggttgtgctgcagcagtgagttcgaggcccaggtttctgcacttggtgagctgccttcgtctatcccactggattcctcatctgcagggatgcacgccgaggcaatgatgtccaaccagccgatttggcagaccagctgcgtgccagagctcccaacaagttattccactgagctcggatccgccggacctaggacgcggttgctggtgccgattgccggtggcctcgtcgagctcttcgccgccagatacatggcggaggaggagcagatggcggagctggtcatggcgcagtgcggggtgccggcgcgggcgacagagggcgagggggacgagggcggtgccgccgtgcacacgtggccggaggcgccaggcttcgcgtgggacggcgccgacccgcagcgtatgttcggggcggtgccgccgtcgctcagcctattcgacgccgcgggggacccgttcctggtggcgccaccgcccggggtggtcgacgacgcggcggcggcagggtggcagtacgtcgcggcggtggcggcgcagcaggagcagcacggcgcggcgcgcgctggaggcgcggactcggggtccgagggaagcgacttgcagggggaccccgaggacgacggcgacgacgacgtgcaggggcggggcggcggcggcggcaagggcggcggcaagcggcagcagtgcaagaacctggtggcggagcggaagcggaggaagaagctcaacgagcggctctacaagctcaggtcgctcgtccccaacatcaccaagatggaccgcgcttcgatcctcggagatgcgatcgactacatcgtggggctgcagaaccaggtgaaggcgctgcaggacgagctggaggacccggcggacggcgcccccgacgtgctcctggaccatccgccgccggcgagcctggtggggctagagaacgacgactcgccgcgcgcgagcaagagggcccgggtagcggcggcggcgccggcggaggaggagaaggggcacgacatggagccgcaggtggaggtgcggcaagtggaggcgaacgagttcttcctgcaagtgctgtgcgagcacaagcccggccgcttcgtccgcctcatggacgccgtcaacgccctcggcctcgacgtcaccaatgtcaacgtgacctcctacaagaccctcgtcctcaacgtcctcaacgtcgccaggcgggacaacgaggtggcggtgcaggcggacagggtgagggactcgctgctggaggtgacgcgggagtcctacggcgtctggtcggcggcggcaccggcggcggggagcagcggcagcatcgacgtgaagctcgactgcgtcgacgtgaagctcgatggtggcgtcgatgtgcaggcaccggcggctgcggcggaagaccattacggcggctacaaccatctcctccagtacctcacc

SEQ ID NO: 270 - protein, 533 aa, Setaria italica
  Si019518m
MGGGDHRCMAATAAASAGDGGGSVEAALRPLVGANAWDYCIYWRLSPDQRFLEMAGLCCSSEFEAQVSALGELPSSIPLDSSSAGMHAEAMMSNQPIWQTSCVPELPTSYSTELGSAGPRTRLLVPIAGGLVELFAARYMAEEEQMAELVMAQCGVPARATEGEGDEGGAAVHTWPEAPGFAWDGADPQRMFGAVPPSLSLFDAAGDPFLVAPPPGVVDDAAAAGWQYVAAVAAQQEQHGAARAGGADSGSEGSDLQGDPEDDGDDDVQGRGGGGGKGGGKRQQCKNLVAERKRRKKLNERLYKLRSLVPNITKMDRASILGDAIDYIVGLQNQVKALQDELEDPADGAPDVLLDHPPPASLVGLENDDSPRASKRARVAAAAPAEEEKGHDMEPQVEVRQVEANEFFLQVLCEHKPGRFVRLMDAVNALGLDVTNVNVTSYKTLVLNVLNVARRDNEVAVQADRVRDSLLEVTRESYGVWSAAAPAAGSSGSIDVKLDCVDVKLDGGVDVQAPAAAAEDHYGGYNHLLQYLT

SEQ ID NO: 271 - DNA, 1671 bp, Zea mays
  GRMZM2G139372_T02
atgggagggggagtccaccaccaccacccgtgcgtggctgctgatggagatggggccggggccgggcccgggccggccagcgtggaggccgcgttgaggcctcttgtcggcgtcgacgcctgggactactgcgtctactggaggctgtctcctgatcagaggttcttggagatggctgggttctgctgcagcagtcagttcgaggcacagcttccagcgctgggcgacctgcctccatcaatccagctcgactcctcgtctgcagggatgcacgccgaggcaatggtgtccaaccagccgatctggcagagcagccgcgtgccagagctccaaacaggttactccagtggcatggtgcaggagcccgggtccagcggcggcccgaggacgcggctgctggtgcccgtcgccggcggcctcgtcgagctcttcgcggcgagatacatggcggaggaggagcagatggcggagctggtgatggcgcagtgcggggtgccgagcggcggtgaggggggcgcgtggccgccgggattcgcgtgggacggcggcgcctcggacgcgtcgcgtgggatgtacggcgatgcggtgccgccgtcgctcagcctgttcgacgccgccggcagcgtcgcggcggacccgttccaggcggtgcagcaggcgccgggcgccggtggtggtggggtggacgacgtcgccgggtggcagtatgctgctgcggctgggagcgagctggaggcggtgcagctgcagcaggagcagcagccgcgcgatgcggactcggggtccgaggtcagcgacatgcagggggacccagaggacgacggcgacggcgacgcgcaggggcgtggcggcggcaagggcggcgggaagcggcagcagtgcaagaacctcgaggcggagcggaagcggcggaagaagctcaacgagcggctctacaagctcaggtcgctcgtcccgaacatctccaagatggaccgcgcggcgatcctcggggacgccatcgactacatcgtgggcctgcagaaccaggtgaaggcgctgcaggacgagctggaggacccggcggacggcgccggcgcccccgacgtcctcctggaccacccgccgccggcgagcctggtggggctggagaacgacgagtcgccgcccacgagccaccagcacccgctcgccgggaccaagagggcccgtgcggcggcggaggaggaggaggaggagaaggggaatgacatggagccgcaggtggaggtgcggcaggtggaggccaacgagttcttcctgcagatgctgtgcgagcgccggcccgggcgcttcgtccagatcatggactccatcgccgacctgggactggaggtcaccaacgtcaacgtcacctcccacgagagcctcgtcctcaacgtcttccgcgccgccaggcgggacaatgaggtggcagtgcaggcggacagactgagggactcgctgctggaggtgatgcgggagccgtacggcgtatggtcgtcgtcggcgccgcccgtggggatgagcggcagcggcatcgccgacgtgaagcatgacagcgtggacatgaagctcgatggcatcatcgacgggcaggcggcaccgagcgtcgcagtgggggtttcagaggatcactacggcggctacaaccatctcctccaatacctcgct

SEQ ID NO: 272 - protein, 557 aa, Zea mays
  GRMZM2G139372_T02
MGGGVHHHHPCVAADGDGAGAGPGPASVEAALRPLVGVDAWDYCVYWRLSPDQRFLEMAGFCCSSQFEAQLPALGDLPPSIQLDSSSAGMHAEAMVSNQPIWQSSRVPELQTGYSSGMVQEPGSSGGPRTRLLVPVAGGLVELFAARYMAEEEQMAELVMAQCGVPSGGEGGAWPPGFAWDGGASDASRGMYGDAVPPSLSLFDAAGSVAADPFQAVQQAPGAGGGGVDDVAGWQYAAAAGSELEAVQLQQEQQPRDADSGSEVSDMQGDPEDDGDGDAQGRGGGKGGGKRQQCKNLEAERKRRKKLNERLYKLRSLVPNISKMDRAAILGDAIDYIVGLQNQVKALQDELEDPADGAGAPDVLLDHPPPASLVGLENDESPPTSHQHPLAGTKRARAAAEEEEEEKGNDMEPQVEVRQVEANEFFLQMLCERRPGRFVQIMDSIADLGLEVTNVNVTSHESLVLNVFRAARRDNEVAVQADRLRDSLLEVMREPYGVWSSSAPPVGMSGSGIADVKHDSVDMKLDGIIDGQAAPSVAVGVSEDHYGGYNHLLQYLA

SEQ ID NO: 273 - DNA, 1626 bp, Setaria italica
  Si006199m
atgggagggggagatcacccgtgcatggctgccacggcggccgcttctgccgggtatggaggcggcagcgtggaggctgcgctgaggcctcttgttggtgcagacgcctgggactactgcatctactggaggctgtctcttgatgagaggttcttggagatgaccgggttgtgctgcagcagtgagttcgaggcccaggtttctgcacatggcgagctgccttcgtctatcccactggattcctcatctgcagggatgcacgccgaggcaatcatgtccaaccagccgatttggcagaccagcagctgcgtgccagagctcccaacaagttattccactgagctcggatccgccggaccgaggacgcggttgctggtgccgatcgccggcggcctcgtcgagctcttcgccgccagatacatggcggaggacgagcagatggcgaagctggtcatggcgcagtgcggggtgccggcgcgggcgacagagggcgagggggacgagggtggcgccgccgtgcacacgtggccggaggcgccgggcttcgcgtgggacggcgctgacccgcagcgtatgtacggggcggtgccgccgtcgctcagcctgttcgacgccgcgggggacccgttcctggcggcgccaccgcccggggtggtcgacgacgcggcggcggcggggtggcagtacgccgcggcggccgggagcgagccgtcggtggtggcggcgcagcaggagcagcacggcgcggcgcgcactggaggcgcggactcggggtccgaggggagcgacttgctgggggaccccgagggtgacggcgacgcgcaggggcggggcggcggcaagggcgacggcaagcggcagcactgcaagaacctggtggcggagcgaaagcggaggcaaaagctcaacaacgcgctctacaagctcaggtcgctcgtccccaagatcaccaagatggaccgcgcttcgatcctcggagatgcgatcgactacatcgtggggctgcagaaccaggtgaaggcgctgcaggacgagctggaggacccggcggacggcgcccccgacgtgctcctggaccacccgccgccggcgagcctggtagggctggagaacgacgactcaccgcgcgcaagcctccagcagccgccggcgagcaagagggcccgggtacctgcagcagcgccgacggaggaggataaggggcacgacatggagccgcaggtggaggtgcggcaggtggaggcgaacgagttcttcctgcaggtgctgtgcgagcacaagcccggtcgcttcgtccgcctcatggacgccgtcaacgccctcggcctcgacgtcaccaacgtcaacgtcacctcctacaagaccctcgtcctcaacgtcctccgcgtcgtcaggcgggacaacgaggtggcggtgcaggcggacagggtgagggactcgctgctggaggtgacgcgggagtcctacggcgtctggtcgtcggcggtggggagcagcggcagcatcgacgtcaagctcaactgcgtcgacgtgaagctcgatggcggcgtcgatgtgcaggcaccggcggccgcggccacggcggaggaccattatggcggctacaaccatctccaatacctcgcc

SEQ ID NO: 274 - protein, 542 aa, Setaria italica
  Si006199m
MGGGDHPCMAATAAASAGYGGGSVEAALRPLVGADAWDYCIYWRLSLDERFLEMTGLCCSSEFEAQVSAHGELPSSIPLDSSSAGMHAEAIMSNQPIWQTSSCVPELPTSYSTELGSAGPRTRLLVPIAGGLVELFAARYMAEDEQMAKLVMAQCGVPARATEGEGDEGGAAVHTWPEAPGFAWDGADPQRMYGAVPPSLSLFDAAGDPFLAAPPPGVVDDAAAAGWQYAAAAGSEPSVVAAQQEQHGAARTGGADSGSEGSDLLGDPEGDGDAQGRGGGKGDGKRQHCKNLVAERKRRQKLNNALYKLRSLVPKITKMDRASILGDAIDYIVGLQNQVKALQDELEDPADGAPDVLLDHPPPASLVGLENDDSPRASLQQPPASKRARVPAAAPTEEDKGHDMEPQVEVRQVEANEFFLQVLCEHKPGRFVRLMDAVNALGLDVTNVNVTSYKTLVLNVLRVVRRDNEVAVQADRVRDSLLEVTRESYGVWSSAVGSSGSIDVKLNCVDVKLDGGVDVQAPAAAATAEDHYGGYNHLQYLA

SEQ ID NO: 275 - DNA, 1656 bp, Oryza sativa
  LOC_Os02g02820.1
atgggaagaggagaccacctgctgatgaagaacagcaatgctgctgcagctgcagctgctgtcaatggaggtggcaccagtttggatgctgcattgaggcctctagttggttcagatggctgggattactgcatctactggaggctctctcctgatcagaggttcttggagatgacaggattctgctgcagcagtgagcttgaagcacaggtctcagcactgctggacctgccttcttcaatcccactggactcctcctccatagggatgcatgcgcaggcattgctgtcgaaccagccgatctggcagagcagcagtgaggaggaggaggctgatggcggcggtggcgccaagacgcggctgctggtccccgtcgccggcggcctcgtcgagctcttcgcgtcgagatatatggcggaggagcagcagatggcggagcttgtcatggcgcagtgcggcggcggcggcgccggggacgacggtggggggcaggcgtggccgccgccggagacgcccagcttccagtgggacggaggcgccgacgcgcagaggctgatgtacggcggctcgtcgctgaacctgttcgacgccgccgccgccgacgacgacccgttcttgggtggtggtggtggtgacgccgtgggcgacgaggcggcggcggcgggcgcgtggccgtacgcggggatggcggtgagcgagccgtcggtggcggtggcgcaggagcagatgcagcacgcggcgggcggcggcgtggcggagtccgggtcggaggggaggaagctgcatggcggtgacccggaggacgacggcgacggcgaggggcgctccggcggcgccaagaggcagcagtgcaagaacctcgaggcggagaggaagcggaggaagaagctcaatggccacctctacaagctccgctcgctcgtcccaaacatcaccaagatggatcgcgcgtcgattcttggagacgcgatcgactacatcgtggggttgcagaagcaggtgaaggagctgcaggacgagctggaagacaaccatgtccaccataagccgcccgacgtgctcatcgaccacccgccgccggcgagcctcgtcgggctcgacaacgacgacgcctcgccgcccaacagccaccaacagcagccgccgctcgccgtttccggcagcagcagcaggaggagtaacaaggacccagcaatgaccgacgacaaggtcggcggcggcggcggcggtgggcaccggatggagccgcagctggaggtgcgtcaggtgcaggggaacgagctgttcgtccaggtgctctgggagcacaagcccggcgggttcgtccgcctcatggacgccatgaacgcgctcggcctcgaggtcatcaacgtcaacgtcaccacctacaagaccctcgtcctcaacgtcttccgcgtcatggtgagggacagcgaggtggcggtgcaggcggacagggtgagggactcgctgctggaggtgacgcgggagacgtaccccggcgtgtggccgtcgccgcaggaggaggacgacgccaagttcgacggcggcgacggcgggcaggctgcggcggcggcggcggcggccggtggagagcactaccacgacgaagtcggcggcggataccatcagcacctgcattacctcgcgtttgat

SEQ ID NO: 276 - protein, 552 aa, Oryza sativa
  LOC_Os02g02820.1
MGRGDHLLMKNSNAAAAAAAVNGGGTSLDAALRPLVGSDGWDYCIYWRLSPDQRFLEMTGFCCSSELEAQVSALLDLPSSIPLDSSSIGMHAQALLSNQPIWQSSSEEEEADGGGGAKTRLLVPVAGGLVELFASRYMAEEQQMAELVMAQCGGGGAGDDGGGQAWPPPETPSFQWDGGADAQRLMYGGSSLNLFDAAAADDDPFLGGGGGDAVGDEAAAAGAWPYAGMAVSEPSVAVAQEQMQHAAGGGVAESGSEGRKLHGGDPEDDGDGEGRSGGAKRQQCKNLEAERKRRKKLNGHLYKLRSLVPNITKMDRASILGDAIDYIVGLQKQVKELQDELEDNHVHHKPPDVLIDHPPPASLVGLDNDDASPPNSHQQQPPLAVSGSSSRRSNKDPAMTDDKVGGGGGGGHRMEPQLEVRQVQGNELFVQVLWEHKPGGFVRLMDAMNALGLEVINVNVTTYKTLVLNVFRVMVRDSEVAVQADRVRDSLLEVTRETYPGVWPSPQEEDDAKFDGGDGGQAAAAAAAAGGEHYHDEVGGGYHQHLHYLAFD

SEQ ID NO: 277 - DNA, 1413 bp, Citrus clementina
  clementine0.9_032563m
atgagagacttggagaaagctgttgagtggctaagaccctttgttgattcaaaggcttgggattattgtgttgtgtggaagttaggtgatgacccttcaagtggtggtgttgggggtggttttgagtatgttaaggtcaaagaagaaagtggggaagagcagaagttttctttctgcagggatgctcacttgaagcattctgcgaggaccaaggcttgtgaggctcttgcccagttaccttctttcatggatctttattctggaaagatttcgtatttgaatgaaacgttcagaattcatggagaggtggtgattacaaaccagcccaagtggattagccttgccaattcctcagactcgattgcttcacatcaatcaaattccactcgagttctaattcctgtttttggtggtcttattgaactctttgccgcaaagcatatatcaaaagatcagaacatcatagagttagtcctagctcactgtaacacatctatagaacaaagagttgtgccagcaggaagctcttacgatgtgggcctagatgaaaaatgtcttgatatcttgctcaaagagaacttacaaaactttccatctcctcttcagttgttaacattcgttcccggtacccaagttctttctgctgcaacccaatttaacacccacccttacaatgagggatcatccaggggttcaaatccttcaattgagcatccatcatttgattcaaattatggctacattgctcaaaatgcacctctgatgcagccaattggaaattccttcgccaaaagacctaagtgcaaaagccatgtgtttaaggaagaactgggagaaagacacaggctgggaagggccaagaatcttattacagaaaggaacaggaggaacaagctaaaagatgggctctttgctttacgcgctctagtccccaagatatccaagatggatagagctgctattctaggagatgcagctgaatatattaaggagttgctgcaggaggtggataaactccaggatgaactaaaggaaaatgaggactgtgagaaggataatgaagaaatgaaatcattcaaattggatgagatacatgaaggcaccagcaccacgtacttgcctgctagtgagcacaataaaagtttcccagcctgtggcgaaaagggaaaatcagaggtgcgagtagaagtgaaccagatcaacgatagagatttcttaattaagctgttgtgtgagcatgagcgaggtggatttgtgaggttgatggaggctataaattctttagagcttcaagtgatagatgccaatgttaccacattcaatggcaaggtgctgaacattctcagggttcaggcacataaggaaaacattcgactgaagaaattaagagagacattgatcgagctaacaggg

SEQ ID NO: 278 - protein, 471 aa, Citrus clementina
  clementine0.9_032563m
MRDLEKAVEWLRPFVDSKAWDYCVVWKLGDDPSSGGVGGGFEYVKVKEESGEEQKFSFCRDAHLKHSARTKACEALAQLPSFMDLYSGKISYLNETFRIHGEVVITNQPKWISLANSSDSIASHQSNSTRVLIPVFGGLIELFAAKHISKDQNIIELVLAHCNTSIEQRVVPAGSSYDVGLDEKCLDILLKENLQNFPSPLQLLTFVPGTQVLSAATQFNTHPYNEGSSRGSNPSIEHPSFDSNYGYIAQNAPLMQPIGNSFAKRPKCKSHVFKEELGERHRLGRAKNLITERNRRNKLKDGLFALRALVPKISKMDRAAILGDAAEYIKELLQEVDKLQDELKENEDCEKDNEEMKSFKLDEIHEGTSTTYLPASEHNKSFPACGEKGKSEVRVEVNQINDRDFLIKLLCEHERGGFVRLMEAINSLELQVIDANVTTFNGKVLNILRVQAHKENIRLKKLRETLIELTG

SEQ ID NO: 279 - DNA, 1458 bp, Populus trichocarpa
  POPTR_0008s19390.1
atgagaggattggacagagcaatggaacggcttagaccccttgttgactccaacgcttgggattactgtgttgtatggaagttaggcgatgatccttcaaggtttattgagtgggtgggttgctgctgcggtggcggtggcggtggtggctacaatgtggaaagggacagaggagaagacaaccaatttgggcggggtcctctttgtaaggatgtctactttaagcatccagtcagaacaaaggcttgtgaggctctttctcggttcccttcttccatgcctctgtattctgggattcatggagaggtggtgatatcagctgagcccagatggttatgccatgccacggtcactactcatgactccaataccctacgtgaagtagctggaactcaagtcttgatcccagtaattggtggacttgttgagctttttgcagcaaagcatatgaaaaaagatgagaagatgatagaatctattagagctcattgccatgtccctgtcaaacaagaagccgtgactgaacttgggtattccaattcgagcttcaacgaccaccgtcttgattcattgcttgaagagaatttgccgcattcctgccacttgttaagtttgattccacggacacagtttcttctcccattatcgcagccccgtaacagcattagctttgaaggatcatctagcggttccaatccttcaaacgaagctccatcatttgtttcaaatgcgagtcaactgccgcaacatggacatttggaattatcagttggaaaatccaatcacgacgagaaaattctgaagcaacgagcaggttctgcagattgcaacaagaaagttccaaaagttatgaggaggtcggaaagagatgactacaaatctaagaatcttgtcacagaaaggaacaggaggacaaggattaaaactggcttatttgctctgcgtgccttggtccccaagatttccaagatggataaagctgcaattcttggagatgcaattgattatgtcggcgagttgctcaaggaggtgaaaaacctccaggatgagatcaagaatgctgaagaagaggaacgcagagcgagcaacattgagctaaagacttcaaaactggagatctttcaggaagaccacgtgtcttcttctaagatcaaccaggattcttctggttttgtagaaaagaaaggggcagaggtgcaattagaagtggaccagattagcaaaagacagttcctgctaaagttcctttgtgaacagaggcaaggaggtttcgggaggttgatggaaaccatccattctttggggcttcaaatccttgatgccaatattacaacatttaatggcaatgttctgaacattctcaaggtcgaggcggataaggacattcatccaaagacactgaagaagtcattgatcgagctaacagggaacctaattcagacatttggtagtcaaatt

SEQ ID NO: 280 - protein, 486 aa, Populus trichocarpa
  POPTR_0008s19390.1
MRGLDRAMERLRPLVDSNAWDYCVVWKLGDDPSRFIEWVGCCCGGGGGGGYNVERDRGEDNQFGRGPLCKDVYFKHPVRTKACEALSRFPSSMPLYSGIHGEVVISAEPRWLCHATVTTHDSNTLREVAGTQVLIPVIGGLVELFAAKHMKKDEKMIESIRAHCHVPVKQEAVTELGYSNSSFNDHRLDSLLEENLPHSCHLLSLIPRTQFLLPLSQPRNSISFEGSSSGSNPSNEAPSFVSNASQLPQHGHLELSVGKSNHDEKILKQRAGSADCNKKVPKVMRRSERDDYKSKNLVTERNRRTRIKTGLFALRALVPKISKMDKAAILGDAIDYVGELLKEVKNLQDEIKNAEEEERRASNIELKTSKLEIFQEDHVSSSKINQDSSGFVEKKGAEVQLEVDQISKRQFLLKFLCEQRQGGFGRLMETIHSLGLQILDANITTFNGNVLNILKVEADKDIHPKTLKKSLIELTGNLIQTFGSQI

SEQ ID NO: 281 - DNA, 1050 bp, Arabidopsis thaliana
  AT3G18010.1
atgtggacgatgggttacaacgaaggaggcgcagattccttcaacggaggaagaaagcttcgtcctctcatcccacgtctcacttcttgccccaccgccgccgtaaacaccaactccgaccaccgctttaatatggcagtggtgacgatgacggcggagcagaacaagagggagctgatgatgctaaactcagaacctcaacatccaccggtaatggtgagctcacggtggaatccgacaccagatcagttaagggttcttgaagagctttaccgacaaggaactagaactccttctgccgaccacatccaacaaatcaccgcacagctacgacggtacgggaagatagaaggcaaaaacgttttctattggttccaaaaccacaaagcccgagaacgccagaaacgacggcgacaaatggaaactggccacgaagaaacggtcctttcaacagcaagtcttgtctcaaaccacggattcgacaagaaagatcctccaggttacaaggttgaacaggtcaagaactggatatgttcggtcggatgcgacacgcaaccagagaaaccttcccgtgattatcatctggaggagccagcgaatatacgggtggagcacaatgctcgttgtggaggagacgagagacgaagctttttagggataaacaccacgtggcagatgatgcagttgccacctagtttctactcttcttcacatcatcatcatcaacgtaacctcattctcaattcacctactgtttcctccaacatgtccaacagcaacaatgctgtctctgcttctaaagatacggtcacggtttcacctgtatttctacgtacgagagaagcaacgaacacagagacttgtcatcgaaatggtgatgataataaagatcaagaacaacatgaagattgctccaacggtgaattggatcatcaagaacagacacttgagctgtttccactgagaaaagaagggttttgtagcgatggtgagaaagacaagaacattagtggcattcactgtttctatgagtttctgccattgaagaac

SEQ ID NO: 282 - protein, 350 aa, Arabidopsis thaliana
  AT3G18010.1
MWTMGYNEGGADSFNGGRKLRPLIPRLTSCPTAAVNTNSDHRFNMAVVTMTAEQNKRELMMLNSEPQHPPVMVSSRWNPTPDQLRVLEELYRQGTRTPSADHIQQITAQLRRYGKIEGKNVFYWFQNHKARERQKRRRQMETGHEETVLSTASLVSNHGFDKKDPPGYKVEQVKNWICSVGCDTQPEKPSRDYHLEEPANIRVEHNARCGGDERRSFLGINTTWQMMQLPPSFYSSSHHHHQRNLILNSPTVSSNMSNSNNAVSASKDTVTVSPVFLRTREATNTETCHRNGDDNKDQEQHEDCSNGELDHQEQTLELFPLRKEGFCSDGEKDKNISGIHCFYEFLPLKN

SEQ ID NO: 283 - DNA, 1101 bp, Eucalyptus grandis
  Eucgr.B00945.1
atgggttgtcatgatgatggagatctgtacatggccgaatccttcaacggccgaaagctccggcccctcatgccgaggccggtcaccaatccttcccctaataacggcggcaccaacgctgcgccgccttgcttgagccgtatccacggtgccgacattttggcactgaatcaccatctcgcgactatggctgagcaaaaaagagagttcaattcgccacaggtagtggtgagctcacggtggaaccccacaccggagcagctacggaccctcgaggagctataccggcgcgggacccggacccccaacgccgaccaaatccagcagatcaccgcgcagctccgccggtacggcaagatcgaggggaagaacgtcttctactggttccaaaaccacaaggccagggaacggcagaagcgccgccgccagatggaggcaggccctgaggagccgaaccgtgatgctgaagaatcagaaaggaaagaaacaggcgcgagtaggacagggcttgaagttgaagagaccaagaacaactgggcaccccctataaactgcagtacactagcagaggaacccgcaggggctacgactcagaaggcaccaaaagcaggatcggcagcaactttggcagagcgtagaacgagatcgtcgtcgtctgatcagtggatcaaattcgacgatggagaatttcagtggacgagaaggcacagcgccagcaactttctggagaggaatgccacgtggcagatgatgcagctgccctcttgtcctcatcccacccacctcataaataccacagccccgtccacagtcgcaccgcctgccaccccatctctcctctccgccgctgctagggcatcatcgatggaccctaacaagatcctcaaggctcatgaactcaggagcttcttcatgtcctcgccgttccgagacgaccacgatctggcaagcggcggcggcggtggcggccgagagtgcgaggaggactcccaaacccttcaattgttcccgctccgcagcggcgacgacttcgatgggaagagcgccagccctccgtcccatcatcagcaccagttctttgagttcctacctttgaagaat

SEQ ID NO: 284 - protein, 367 aa, Eucalyptus grandis
  Eucgr.B00945.1
MGCHDDGDLYMAESFNGRKLRPLMPRPVTNPSPNNGGTNAAPPCLSRIHGADILALNHHLATMAEQKREFNSPQVVVSSRWNPTPEQLRTLEELYRRGTRTPNADQIQQITAQLRRYGKIEGKNVFYWFQNHKARERQKRRRQMEAGPEEPNRDAEESERKETGASRTGLEVEETKNNWAPPINCSTLAEEPAGATTQKAPKAGSAATLAERRTRSSSSDQWIKFDDGEFQWTRRHSASNFLERNATWQMMQLPSCPHPTHLINTTAPSTVAPPATPSLLSAAARASSMDPNKILKAHELRSFFMSSPFRDDHDLASGGGGGGRECEEDSQTLQLFPLRSGDDFDGKSASPPSHHQHQFFEFLPLKN

SEQ ID NO: 285 - DNA, 774 bp, Glycine max
  Glyma08g05830.1
atgtggatggttggttacaatgaaggagctgagttcaacatggccgattatggattcaatggaaggaaactaaggcctctcatgccaaggccagtcacttctcctaacaatacttcaaacactaactctccatacttgacccgcattcatcatggcaacgatttcttttcacagtatcacaatcttgcatcagtggcagatcagggaaagagagagttcaaccctccaccagtagtggtgagttcaaggtggaatccaaccccggagcaactgagagcattggaggaattgtatagaagagggacaagaacaccatctgcggagcaaatccaacaaatcacggcacagcttaggaggtttggaaaaattgaagggaagaatgtcttctattggtttcagaatcacaaagcaagagaaagacagaaacgccgccgtcaaatggatactcttgaaaagaagacttcggtaacttgtttctttgcgggcatgaaagagacaagtaacaagaggccttgttttgcaatgcatgggctgatggcttcttttgcgcaagtaggacagtgcttgaagttgaacagaccaagaactgggcaccctctacaaactgcagtactcttgcagaggtctattattctacatcctcctttgtctttgtccttgttcatggactgtttaattttttgttataccatgcaactttatttgaaactaggagtgcatgccaatttgaaatctgtgctgctgtccaataataacttttttacctttgctctt

SEQ ID NO: 286 - protein, 259 aa, Glycine max
  Glyma08g05830.1
MWMVGYNEGAEFNMADYGFNGRKLRPLMPRPVTSPNNTSNTNSPYLTRIHHGNDFFSQYHNLASVADQGKREFNPPPVVVSSRWNPTPEQLRALEELYRRGTRTPSAEQIQQITAQLRRFGKIEGKNVFYWFQNHKARERQKRRRQMDTLEKKTSVTCFFAGMKETSNKRPCFAMHGLMASFAQVGQCLKLNRPRTGHPLQTAVLLQRSIILHPPLSLSLFMDCLIFCYTMQLYLKLGVHANLKSVLLSNNNFFTFALW

SEQ ID NO: 287 - DNA, 1071 bp, Glycine max
  Glyma05g33850.1
atgtggatggttggttacaatgaaggaggcgagttcaacatggctgattatggattcaatgggaggaaactcaggcctctcatgccaaggccagtgacatctcctaacaacacttcaaacacaaactctccatgcttgagccgcattcatcatggcaacaatttcttttcacaatatcacaatctggtggcagatcagggaaagagggagttcaaccctccaccagtagtggtgagttcaaggtggaatccaaccccggagcaactgagagcattggaggaattgtatagaagagggacaagaacaccatctgcggagcaaatccaacaaatcacggcacagcttaggaggtttggaaaaattgaagggaagaatgttttctattggtttcagaatcacaaagcaagagaaagacagaaacgccgccgtcaaatggagtcagctgctgagggtcatcacacccgtgactttgatagtactcttgaaaagaaagacttaggcgcaagtaggacagtgtttgaagttgatcagaccaagaactgggcaccctctacaaactgcagtactcttgcagaggaatctgtttcaatacaaagggcagcaaaagcagcgattgcagagtgtagaacagatggatggctccaattcgatgaaggagagttacaacatagaagaaactttatggagaggaatgccacgtggcatatgatgcagttatcttgtcctccccctcctacagtttcaccccacctcataaacacatctcctattacctctactactagcatggccaccgcaaccacagtaacagcaagactaatggacccaaagctcattaagactcatgatctcagcttctttacttcacctaacagagaaaacggtattatccacttaagcagtatcagcacccaggatgataattctgtggaatctcaaacccttcaactttttccaacaaggaacgcggatcgaagcagtgataacatcaaccagcaaaaagagacagaggtttcggtttcagcgatgaatgcacccagccagttttttgagttccttccattgaagaac

SEQ ID NO: 288 - protein, 357 aa, Glycine max
  Glyma05g33850.1
MWMVGYNEGGEFNMADYGFNGRKLRPLMPRPVTSPNNTSNTNSPCLSRIHHGNNFFSQYHNLVADQGKREFNPPPVVVSSRWNPTPEQLRALEELYRRGTRTPSAEQIQQITAQLRRFGKIEGKNVFYWFQNHKARERQKRRRQMESAAEGHHTRDFDSTLEKKDLGASRTVFEVDQTKNWAPSTNCSTLAEESVSIQRAAKAAIAECRTDGWLQFDEGELQHRRNFMERNATWHMMQLSCPPPPTVSPHLINTSPITSTTSMATATTVTARLMDPKLIKTHDLSFFTSPNRENGIIHLSSISTQDDNSVESQTLQLFPTRNADRSSDNINQQKETEVSVSAMNAPSQFFEFLPLKN

SEQ ID NO: 289 - DNA, 1041 bp, Vitis vinifera
  GSVIVT01008424001
atgtggatgatgggttacaatgatgggggagagctgaatatgcctgattcattcaatggcaggaagcttcggcctctgattccaagaccagctacttctaccagcggcactgcaactaccacgtcttcttgtttaagccgcatccatgggactgatctttttggactgaatcaccatctggagcaaagcaacattagagagttcaatacaactccagtcatagtgagctcacgttggaatccaaccccggagcagctaaggaccctagaagaattatatcggcgcgggactcgaacgccttcggctgagcaaattcagcatatcaccgcacagctccgccgatacggcaagattgaaggcaagaatgtgttttactggtttcagaaccacaaggcaagggaacggcagaagcggcgccgacaacttgaaccagatgagcagaatcgcgatgttgaaagcacagagaggaaggaatcaggaggaagtaggacaggttttgaagaacagaccaagaactgggcactctctacaaactgcagtatacttgcagaggaatctctttcaatacaaagggcagcaaaagcaacagctgcagcagcagaatgtagaacagatggatggatccaattcgatgaaggggaattacagcatagaagaagcttggtagaaagaaatgccatttggcagatgatgcagttgtcttgtccttctcccaccacccacctcataaacacgactactactacaagaaccaaagaagctgcagcagttagaagaatggacccaaagttcataaagactcgagatctgaacatctttatagctccctacagatcagaaggtcataatcacttggccggtgtcggcgccgatcactccaatgaagaagagggtggagaatcccaaacccttcagctgttccccctccggagcggcgatggcaatgaaaacattaatgaaaaagagggcgagatatcagttgctgccatgaataccaacctcactcctcaccagttttttgagttccttccactgaagaat

SEQ ID NO: 290 - protein, 347 aa, Vitis vinifera
  GSVIVT01008424001
MWMMGYNDGGELNMPDSFNGRKLRPLIPRPATSTSGTATTTSSCLSRIHGTDLFGLNHHLEQSNIREFNTTPVIVSSRWNPTPEQLRTLEELYRRGTRTPSAEQIQHITAQLRRYGKIEGKNVFYWFQNHKARERQKRRRQLEPDEQNRDVESTERKESGGSRTGFEEQTKNWALSTNCSILAEESLSIQRAAKATAAAAECRTDGWIQFDEGELQHRRSLVERNAIWQMMQLSCPSPTTHLINTTTTTRTKEAAAVRRMDPKFIKTRDLNIFIAPYRSEGHNHLAGVGADHSNEEEGGESQTLQLFPLRSGDGNENINEKEGEISVAAMNTNLTPHQFFEFLPLKN

SEQ ID NO: 291 - DNA, 1179 bp, Solanum lycopersicum
  Solyc03g118770.2.1
atgtggatgatgggttacaatgagggaggagattttaacatgtcggattcgtgtaatggaagaaagcttcgtccactaatgccgagagtgcctcatgcgcctacggcgaatccaacgaattgcttaagaaattttcatggagaaaactttattgcacttaatcatcatcagcttgctatgagtgagcaaaataagagagatttcaatacgcaattagtagtgagctcacgttggaatccaactccagaacaactgcaaacgctggaagagttgtatcgacgcggcacgagaactccgtcagctgaacagattcagcatatcactgcacaacttagacggtatggcaaaattgaaggaaaaaatgttttctactggtttcaaaatcataaagcaagggaacgccaaaaaagacgccgtcaacttgaatcttctgctaatgggaacggtaatggcggtggtggtgatgatcagtctcagagtaattgtaacgctgaaaatgctgaaagaaaagaatcaggggcaaataggacagtttttgaaattgaacagaccaagcactggccatccccaacaaactgcagtactcttgcagagaaaactgcagcaaaaacaaaggcaggtgcagcatcggcagcggcaggggcaacagcagcaggagttgcagaatcatgtagagtagcagcagcagaaagatggataccattcgacgaaggagaacaaagaaggagcttattagcagaaaggaatgccacgtggcagatgatgcatttgtcttgttcaccacccaccatcaacaacaacaccaattgtgcaacaatttgtagtaatactataactactgcaacttgtactccaattataaggagttgtccatcaacgccaacaacaatcgaccatcagacaaaacaacttttcaagcccaaagatcatctcaacatctttataacaccttttagatgtgatcaaaaacaccaaaacatcatcggagacgaagaagaagaaggcgaaggcaatggtcatgaagcacagactcttgaattatttcccctccgtagcagcaatgacaacaatgatgaaaataatttttcagacaaggatgaaataggagctgccgcgaacttgaataataattttaatggcagtcattatcagttttttgagttccttccactcaagaac

SEQ ID NO: 292 - protein, 393 aa, Solanum lycopersicum
  Solyc03g118770.2.1
MWMMGYNEGGDFNMSDSCNGRKLRPLMPRVPHAPTANPTNCLRNFHGENFIALNHHQLAMSEQNKRDFNTQLVVSSRWNPTPEQLQTLEELYRRGTRTPSAEQIQHITAQLRRYGKIEGKNVFYWFQNHKARERQKRRRQLESSANGNGNGGGGDDQSQSNCNAENAERKESGANRTVFEIEQTKHWPSPTNCSTLAEKTAAKTKAGAASAAAGATAAGVAESCRVAAAERWIPFDEGEQRRSLLAERNATWQMMHLSCSPPTINNNTNCATICSNTITTATCTPIIRSCPSTPTTIDHQTKQLFKPKDHLNIFITPFRCDQKHQNIIGDEEEEGEGNGHEAQTLELFPLRSSNDNNDENNFSDKDEIGAAANLNNNFNGSHYQFFEFLPLKN

SEQ ID NO: 293 - DNA, 747 bp, Glycine max
  Glyma07g11370.1
atgtggatgatgggttatgaaggtggtgagttcaacatggttgaacattcactcattactggaaggaaactcaagcctctcatgccaaggccaatgacgacttctctcaacaatgcaccaacaacaaccactcctagcttatctcagatccatgggaatgacttcctttcacaatatcattatcaccatcttgaacaaaacaagagagagttcaatggtgcagcaccagttgttgtgagctcaaggtggaatccaaccccagagcaactaagagcccttgaagagttatatagaagaggaacaaggacaccatctgccgagcaaatccaacacatcactgcacagcttagaaggtttggtaacattgaagggaagaatgtgttctattggtttcagaatcacaaagccagggagaggcaaaagcgtcgccgccaaatggaatcagatgctgaaactccagagaagaaagatttagggatctgtagattatatctgcaagtaggacagtgtttgaagttgaacggaccaagaactggacaccctcaacaaattgcagtactattgcagaggtctaataatattccatttctaatatcctgcttttcatatccattaagtggtgattattggcagatgattactagagatcaagttgatatgggaaacatgtatattatggaaagatctgcactaggtatagggaaaggacccaacaaaagcttcgtttgttgggaaatgaaaatggcc

SEQ ID NO: 294 - protein, 249 aa, Glycine max
  Glyma07g11370.1
MWMMGYEGGEFNMVEHSLITGRKLKPLMPRPMTTSLNNAPTTTTPSLSQIHGNDFLSQYHYHHLEQNKREFNGAAPVVVSSRWNPTPEQLRALEELYRRGTRTPSAEQIQHITAQLRRFGNIEGKNVFYWFQNHKARERQKRRRQMESDAETPEKKDLGICRLYLQVGQCLKLNGPRTGHPQQIAVLLQRSNNIPFLISCFSYPLSGDYWQMITRDQVDMGNMYIMERSALGIGKGPNKSFVCWEMKMA

SEQ ID NO: 295 - DNA, 1176 bp, Populus trichocarpa
  POPTR_0012s04510.1
atgtggatgatgggttacaatgatagtggtgacttcgacatgccagattctttcaatgacaggaagcttaagactctagttccgaggccactaccctccacaaacaacacttcaactgcctctggccatccttgccctggcagccgtcttcatagtaccgattttcttgctctaaatcagtaccatctgggactgggtatgcatctttcttttcttttatctctctctttaattagagagttcaacacacagccagttgtaatgagctcaagatggaatccaacaccagaacagttaaggaccctcgaggagttgtatcgaagagggactagaacaccctcaactgaccagattcaagacataactgcacagcttcgtagatatggaagaattgaaggaaagaatgtgttctactggtttcaaaaccacaaggcgagagaaaggcaaaaacgtcgacgtcaaatggaatctgattctcttgatgatcatcagcaaaatggacatggtgttgaaatgtttgaaaggaaagaaccaggagcaagtatgacaggttatgaaggtgaacagaccaggaactgggctccctctacaaactgcagtacactatcagaggaatctgtttcaatatcaaaggcaacaaaagcagcaatggcagagtactatagaccagatggatggatcgaattcgatgaaggagaaataatgcagcatagaaggaacctcatagaaaggaatgcgacgtgggagatgatgccgttttcttgcccatctcccacccacctattaaacactatatctagcgctactgctacaactatagctactacaagtgcgtcaacacaaggagcggcaacagtaagaacaatggacccaacaaagctcatgaacgctcatgacctcaacatctttatagcaccttacatagaaaatggttatcatggagcccgtattaaccacttcaataacagcgtcatcaacgagggaggtgaatattgcagagatggcaatgacgaatctcaaacccttcaactatttcctattcgtagtggcggtaacggaaacaatattgaaagaattaacgagagagagactgaggtatcggtttctgctactgaaaccttgaatgctaacgacttctctccttgccagtttttcgagttccttccactgaggatc

SEQ ID NO: 296 - protein, 392 aa, Populus trichocarpa
  POPTR_0012s04510.1
MWMMGYNDSGDFDMPDSFNDRKLKTLVPRPLPSTNNTSTASGHPCPGSRLHSTDFLALNQYHLGLGMHLSFLLSLSLIREFNTQPVVMSSRWNPTPEQLRTLEELYRRGTRTPSTDQIQDITAQLRRYGRIEGKNVFYWFQNHKARERQKRRRQMESDSLDDHQQNGHGVEMFERKEPGASMTGYEGEQTRNWAPSTNCSTLSEESVSISKATKAAMAEYYRPDGWIEFDEGEIMQHRRNLIERNATWEMMPFSCPSPTHLLNTISSATATTIATTSASTQGAATVRTMDPTKLMNAHDLNIFIAPYIENGYHGARINHFNNSVINEGGEYCRDGNDESQTLQLFPIRSGGNGNNIERINERETEVSVSATETLNANDFSPCQFFEFLPLRI

SEQ ID NO: 297 - DNA, 576 bp, Glycine max
  Glyma09g30830.1
gcagaaaaaaacaagagagagttcaatggtgcaacaccagttgtggtgagctcaaggtggaatccaagcccagagcaactaagagcccttgaagaattgtacagaagaggaacaaggacaccatctgctgagcaaatccaacacatcactgcacagcttagaaggtttggtaacattgaagggaagaatgtgttctattggtttcagaatcacaaagccagggagaggcaaaagcgccgccgccaaatggaatcagatgctgaacctccagagaagaaagatttagctgcaagtaggacagtgtttgaagttgaacggaccaagaactggacaccctcaacaaactgcagtactatggcagagcaaaaagttcataagcatgatccattaaatcaagttgatatgggaaacatgtatattatggaaagatctgcactaggtatagggaaagtacccaacaaaagcttcctctgcttttggggcttgtgttgtgctcattcatgtcatttagaaattaatttgaatcaacaacttttaataataaagttcatatcgaaatgcgtgcaaaaattactt

SEQ ID NO: 298 - protein, 192 aa, Glycine max
  Glyma09g30830.1
AEKNKREFNGATPVVVSSRWNPSPEQLRALEELYRRGTRTPSAEQIQHITAQLRRFGNIEGKNVFYWFQNHKARERQKRRRQMESDAEPPEKKDLAASRTVFEVERTKNWTPSTNCSTMAEQKVHKHDPLNQVDMGNMYIMERSALGIGKVPNKSFLCFWGLCCAHSCHLEINLNQQLLIIKFISKCVQKLL

SEQ ID NO: 299 - DNA, 1158 bp, Populus trichocarpa
  POPTR_0015s04520.1
atgtggatgatgggttataatgatggtggtgaattcaacatatcagattctttcaatggcaggaagcttaggccactagttccaaggccaataccctctacaaacaacactccaactgcctctagtcctccttgccttggcagtcgccttcataacaccgatttctttgcactcaatcagtatcatctgggtatgcatctttcttttcttttctctctctccctctcaagtatggctgatcaaaacaaaagagaattcaacacacagccagttgtaatgagctcaagatggaatccaacaccggagcagttaaggacccttgaagatttgtatcgaagagggactagaacaccctcaactgaccaaattcaagacataaccgcacagcttcgtagatatggaaggattgaaggaaagaatgtgttttactggtttcaaaaccacaaggcaagagaaaggcaaaagcgtcgacgtcaaatggaatctgattcttttgatggtcatctgcaaaatggacatggtattgaaatctttgaaaggaaagaatcagaggcaagtaggacaggttatgaaggtgaacaaaccaagaactgggctccctctacaaactgcagtacactatcagaggaatctgtttcaatatcaagggcaacaaaaggagcaatggcagagtactgtagaccagatggatggatgcaactcgatgaaggagaattacagcatagaaggaactttatagaaaggaatgccacgtgggagatgatgcagttgtcttgtccatctcccacccaccaaagaaacactatctctagtactagtagcactacaactatgtcaaaacaaggagcagcagcagcgaagctcattaaggctcatgacctcaacgtctttatagcaccttacagagaaaatgggcatcatggagcccttattaaccagttcaatagcagtgtcatcaatgacggggatgaatccagaggtggtactggggaatctcaaacccttcaactgtttcctcttcgtagtggcggtgacggcaacaataatatcgaaagcattaacgagagagagagtgaggtatcagtttctgctgctgaagctttgaatgctaataacttcgctccttgccagttctttgagttccttccactgaagcac

SEQ ID NO: 300 - protein, 386 aa, Populus trichocarpa
  POPTR_0015s04520.1
MWMMGYNDGGEFNISDSFNGRKLRPLVPRPIPSTNNTPTASSPPCLGSRLHNTDFFALNQYHLGMHLSFLFSLSLSSMADQNKREFNTQPVVMSSRWNPTPEQLRTLEDLYRRGTRTPSTDQIQDITAQLRRYGRIEGKNVFYWFQNHKARERQKRRRQMESDSFDGHLQNGHGIEIFERKESEASRTGYEGEQTKNWAPSTNCSTLSEESVSISRATKGAMAEYCRPDGWMQLDEGELQHRRNFIERNATWEMMQLSCPSPTHQRNTISSTSSTTTMSKQGAAAAKLIKAHDLNVFIAPYRENGHHGALINQFNSSVINDGDESRGGTGESQTLQLFPLRSGGDGNNNIESINERESEVSVSAAEALNANNFAPCQFFEFLPLKH

SEQ ID NO: 301 - DNA, 1011 bp, Vitis vinifera
  GSVIVT01011738001
atgtggacgatggattctagtgatagcagcgaccttaccatgtctgattccttccatggtcggaaacttcggcctctcgttccaaggcctaatgcttctgtcctccccaagattacagtgaattctacagtggcaatctctccttgtattagtcaccttcatggcactgatctttttgcattgaatcaccatctgggtggtacatctgatcagcaaagaaagacagatttcaacacacaacccttcgggagctcaaggtggaatccaacaccagagcagctacaagccctggaggagctgtatcgacgaggaacgcgaacacccactgctgaacaaatccaacaaattgctgcacaacttcgtctgttcggcaagattgaagggaagaatgtgttttactggtttcaaaatcataaagcgcgagaacgccagaaacgccgtagagagttggagtcagattctgaagaacaacagcgtgataatggtagcctagaaaggaaagaatcagtgctgagaaggacatgtattgaagttgaacagacaaagaactgggtggtgccctcttcaaactgcagtacactctctgaggaatctgtttcaatacagagagcagcggttgcagaaagtagaacagatgtgtggtttcaatttgaggagagagaattacagcagacaagaagcacagtagaaaggcaggccacatggcagttgatggggctcacctcttctcctccttcccaacttatagacaccataaccacaaccaccgtagccgaagcattgaatacaatatacccaaagcagaagccattaagccctcaaagtctcagacccaacacccacctcgaacatgaaaccagggagtctcaaacccttcaactcttcccagttcaggggggccagagcttcaatgctgctaatgaaatcattagcgtggctgagatggagaatggattacccatcacaaccatagacaccaacttcactccaaaccagttttttgagttcctc

SEQ ID NO: 302 - protein, 337 aa, Vitis vinifera
  GSVIVT01011738001
MWTMDSSDSSDLTMSDSFHGRKLRPLVPRPNASVLPKITVNSTVAISPCISHLHGTDLFALNHHLGGTSDQQRKTDFNTQPFGSSRWNPTPEQLQALEELYRRGTRTPTAEQIQQIAAQLRLFGKIEGKNVFYWFQNHKARERQKRRRELESDSEEQQRDNGSLERKESVLRRTCIEVEQTKNWVVPSSNCSTLSEESVSIQRAAVAESRTDVWFQFEERELQQTRSTVERQATWQLMGLTSSPPSQLIDTITTTTVAEALNTIYPKQKPLSPQSLRPNTHLEHETRESQTLQLFPVQGGQSFNAANEIISVAEMENGLPITTIDTNFTPNQFFEFL

SEQ ID NO: 303 - DNA, 645 bp, Glycine max
  Glyma20g02160.1
tctaaattaaccttcaacatgtctgattcatttggtagcacctttcactcttccactccaaactccaccctcaattcccatgcaccccccaaaatcaccacattctgctcaatagcccaaccttattgcatttgcacccactgcaaccacatcctcaccttcaaccaccatgttggtaattcccagcagcaacaaagcacaaggtggagtccaaccccagttcagttactagtccttgaggaattgtataggcaaggcacaaaaacaccctcagctgaacaaattcaacaaatagcttcacagttacgccagtttgggaagattgaagggaagaacgtgttctactggttccagaatcacaaggccagagagagacagaagcggcggttgaaagagacaggttgtggagttaaagagacaaagaagtgggcatccacttcaaactgcagtggacatgcagagggtctaggtgaaataaaagataaagccaaaaatcaattttcttttactcggtatagtgaatcagtgttcacacttttgttggacggtgaattgatgagtgtgaattctgaagtctgtgaattctccccttccccattttttctctctctattctatctctttttttctctattttttagtttt

SEQ ID NO: 304 - protein, 215 aa, Glycine max
  Glyma20g02160.1
SKLTFNMSDSFGSTFHSSTPNSTLNSHAPPKITTFCSIAQPYCICTHCNHILTFNHHVGNSQQQQSTRWSPTPVQLLVLEELYRQGTKTPSAEQIQQIASQLRQFGKIEGKNVFYWFQNHKARERQKRRLKETGCGVKETKKWASTSNCSGHAEGLGEIKDKAKNQFSFTRYSESVFTLLLDGELMSVNSEVCEFSPSPFFLSLFYLFFSLFFSF

SEQ ID NO: 305 - DNA, 780 bp, Arabidopsis thaliana
  AT5G59340.1
atggaaaacgaagtaaacgcaggaacagcaagcagttcaagatggaacccaacgaaagatcagatcacgctactggaaaatctttacaaggaaggaatacgaactccgagcgccgatcagattcagcagatcaccggtaggcttcgtgcgtacggccatatcgaaggtaaaaacgtcttttactggttccagaaccataaggctaggcaacgccaaaagcagaaacaggagcgcatggcttacttcaatcgcctcctccacaaaacctcccgtttcttctacccccctccttgctcaaacgtgggttgtgtcagtccgtactatttacagcaagcaagtgatcatcatatgaatcaacatggaagtgtatacacaaacgatcttcttcacagaaacaatgtgatgattccaagtggtggctacgagaaacggacagtcacacaacatcagaaacaactttcagacataagaacaacagcagccacaagaatgccaatttctccgagttcactcagatttgacagatttgccctccgtgataactgttatgccggtgaggacattaacgtcaattccagtggacggaaaacactccctctttttcctcttcagcctttgaatgcaagtaatgctgatggtatgggaagttccagttttgcccttggtagtgattctccggtggattgttctagcgatggagccggccgagagcagccgtttattgatttcttttctggtggttctacttctactcgtttcgatagtaatggtaatgggttg

SEQ ID NO: 306 - protein, 260 aa, Arabidopsis thaliana
  AT5G59340.1
MENEVNAGTASSSRWNPTKDQITLLENLYKEGIRTPSADQIQQITGRLRAYGHIEGKNVFYWFQNHKARQRQKQKQERMAYFNRLLHKTSRFFYPPPCSNVGCVSPYYLQQASDHHMNQHGSVYTNDLLHRNNVMIPSGGYEKRTVTQHQKQLSDIRTTAATRMPISPSSLRFDRFALRDNCYAGEDINVNSSGRKTLPLFPLQPLNASNADGMGSSSFALGSDSPVDCSSDGAGREQPFIDFFSGGSTSTRFDSNGNGL

SEQ ID NO: 307 - DNA, 647 bp, Glycine max
  Glyma11g14940.1
atggagagtggagggagtaatggtaatgagggggttgcagcgagttcgcggtggaaccctacaaaagagcaaataagcatgctagagaatttgtataagcagggaataaagactccgagtgctgaggagatacagcagataactgctaggcttagggcgtatggtcacatcgaaggaaagaatgtcttctactggtttcagaaccacaaagccagacagagacagaagcagaagcaagaaacctttgcttacttcaatcgctttcttcatacgcctcagccttttttttctccgccaatttgcccaaatggttccccaatcatgatagacggacagctgtttcttttgcttttttttttcaaaaccatgtgtgccccatattacatacctcagggacagggtgaaattgggttttatcccccacaccaaaaggtatttgtacccgtaggttttaggaggagcccctctgagaaagttgtgcccacaggcatgataagtagtaatggccctctggtatacgaaggcatgcatcaaatgcaacagagaatctcggattgcagcaactctcacttcagtcaccaagaaacgttggatcttttccctctgcacccaaccggcattttggaagggaaaacaacaacaacaac

SEQ ID NO: 308 - protein, 217 aa, Glycine max
  misc_feature (217)..(217): Xaa can be any naturally occurring amino acid
  Glyma11g14940.1
MESGGSNGNEGVAASSRWNPTKEQISMLENLYKQGIKTPSAEEIQQITARLRAYGHIEGKNVFYWFQNHKARQRQKQKQETFAYFNRFLHTPQPFFSPPICPNGSPIMIDGQLFLLLFFFKTMCAPYYIPQGQGEIGFYPPHQKVFVPVGFRRSPSEKVVPTGMISSNGPLVYEGMHQMQQRISDCSNSHFSHQETLDLFPLHPTGILEGKTTTTTX

SEQ ID NO: 309 - DNA, 948 bp, Populus trichocarpa
  POPTR_0010s12150.1
atgtggatgataaatggtggtgacagcaatgagcctagcatgaacgatttcttcaacccaaagcccaacactactacactttgcacatatactactgcaactcctctcacctatgtaggactaaaacatcatctcgccaaaacaagtgagcaaagcagggggagaaaactcaaagagcaagcagaagcaacgagaagttcgagatggaacccaacagcagagcagctactagcactagaagaaaagtacagttgcggagttcgaactccaacaactaaccaaatccaacaaataacttcagagcttcgaaggtttgggaagattgaagggaagaatgtgttttactggtttcaaaaccacaaggcaagagaaagacaaaaacaccgtcaagtacaacaaaaacacaataatactgatcatgaaagctcgaataagatgaaagaatcaggtccgaggaggacagttcttggagttgatcaaacaaacaacttggcacctcattcaaaatgcagtactgatcatgtagagggacctgtttcagtgaatggagcagcaatagcagaaagtggaacacatgggtggtcagaatttgaggagagggaattacagcagatgaaaagtatcagtcttgatatgcatgccatgtggcaaactatggacttgtcttcctctactcccgtccaccgcttgactagcaccatgaccacaacagcgtcaaaattctcaagccttgaagagcacagttcgctgttgagacccaccaagacagcaactcatgcaaatcatgatggtgaaattagggaagttcaaactcttcagctgtttccactttgtagtgatgatggtaatggtgctaatggtaccaataatgacagaaatgtacccatcaggaccataaatacgaccttcaccccaagccagttttttgagtttcttcctctgaagaac

SEQ ID NO: 310 - protein, 316 aa, Populus trichocarpa
  POPTR_0010s12150.1
MWMINGGDSNEPSMNDFFNPKPNTTTLCTYTTATPLTYVGLKHHLAKTSEQSRGRKLKEQAEATRSSRWNPTAEQLLALEEKYSCGVRTPTTNQIQQITSELRRFGKIEGKNVFYWFQNHKARERQKHRQVQQKHNNTDHESSNKMKESGPRRTVLGVDQTNNLAPHSKCSTDHVEGPVSVNGAAIAESGTHGWSEFEERELQQMKSISLDMHAMWQTMDLSSSTPVHRLTSTMTTTASKFSSLEEHSSLLRPTKTATHANHDGEIREVQTLQLFPLCSDDGNGANGTNNDRNVPIRTINTTFTPSQFFEFLPLKN

SEQ ID NO: 311 - DNA, 720 bp, Solanum lycopersicum
  Solyc06g076000.1.1
atgagtgatagtagtgttgatatgataacatctggtggaagtccagttggatgtagatggaatccaacaaaggaacaaattgatttgcttgaaagtttatataagcaagggataaggacaccaagtgctgaccaaatacaacaaattactgggaggttaagggcttttggtcacattgagggtaaaaatgtattttattggtttcaaaatcataaggcaaggcaacgacagaaacagaagcaagataaatttgcttactacaatcgatttcttcatcggacttctgtttttcctccacctaattgcccaaacggttttgtagttgtttgcagcccttattacacagcacaaaacaatctagggttttatcagcagtatccagcagttcctagtatgatcatccctggaccaggtggtttcaaaagaagggcaacatgtaatcaagaaactctgaatctttgtgaacaaaacaacagcccaaatgcaaataaggagtttataactcaagaaacattgaatctttttccactgcacccaactggggttttacaagaaaagactacaatagctgactcttcttcgtcgtcgtctacttgtgttcctcgtgatcatctatccagtaatactacttcaaattcagtggaagtgaactgttttactgatcttggaattggtgcttctgatagacctcagccagtctttaactttctatgtggaaat

SEQ ID NO: 312 - protein, 240 aa, Solanum lycopersicum
  Solyc06g076000.1.1
MSDSSVDMITSGGSPVGCRWNPTKEQIDLLESLYKQGIRTPSADQIQQITGRLRAFGHIEGKNVFYWFQNHKARQRQKQKQDKFAYYNRFLHRTSVFPPPNCPNGFVVVCSPYYTAQNNLGFYQQYPAVPSMIIPGPGGFKRRATCNQETLNLCEQNNSPNANKEFITQETLNLFPLHPTGVLQEKTTIADSSSSSSTCVPRDHLSSNTTSNSVEVNCFTDLGIGASDRPQPVFNFLCGN

SEQ ID NO: 313 - DNA, 753 bp, Eucalyptus grandis
  Eucgr.B02379.1
atgggcggctccggagggggctcgccggcgacctcgcggtggaacccgacgaaggagcagatcggtatactggagagcctgtacaggcaagggataaggacgccgacggcggatcagatacagcagataacggggaggctcaaggcgtacggccacatcgagggcaagaacgtgttctactggttccagaaccacaaggcccggcagaggcagaaggagaagcaggagagcctggcttacctcaaccgctacttccacaagtctgctcgcaccgcctttcatcctccttgcccaaatgctgtttgtggaccgtacttcgtgccgcagagtgacatagggacgatgtacccacaatgcccgaaggtgcttcttccttgtggcatcaagaggagacagaagactgacttcgtagagagaacaaaaacattctgtcgtacgggttttgcgtaccccgcgcacccccaaggacatcatcatgacgtgacgttccaccaaacagctgagagcaacaacgacagcaccgtcgagagaaatcaagaaactttggacctctttcctttgcacccaacaggcagggcggtacaagatacgtcaaagtgttctcaagctgatcacgactgttctcgtgctgatcaagactgttcggcaacgacctccacttcttcttcttcggaggctcgagatggtggtaacaacggtgaccagcctttctttgatttcttctcagcaaacggatgcttctgcgagagagac

SEQ ID NO: 314 - protein, 251 aa, Eucalyptus grandis
  Eucgr.B02379.1
MGGSGGGSPATSRWNPTKEQIGILESLYRQGIRTPTADQIQQITGRLKAYGHIEGKNVFYWFQNHKARQRQKEKQESLAYLNRYFHKSARTAFHPPCPNAVCGPYFVPQSDIGTMYPQCPKVLLPCGIKRRQKTDFVERTKTFCRTGFAYPAHPQGHHHDVTFHQTAESNNDSTVERNQETLDLFPLHPTGRAVQDTSKCSQADHDCSRADQDCSATTSTSSSSEARDGGNNGDQPFFDFFSANGCFCERD

SEQ ID NO: 315 - DNA, 939 bp, Oryza sativa
  LOC_Os01g62310.1
atggagacgacgacgacgacgttgggcggcggcggcggcgggcgggcgggaggcttctccgatccgccgtctccgctctcgccgccgctgtcgccggcctcggcggcggcggcggcgctggcgaacgcgcggtggacgccgaccaaggagcagatcgcggtgctggaggggctgtaccggcaggggctgcgcacgccgaccgccgagcagatacagcagatcacggcgaggctccgggagcacggccacattgagggcaagaacgtgttctactggttccagaaccacaaggcccggcagcggcagaagcagaagcagcagagcttcgactacttcagcaagctgttccgccgcccgccgccgctgcccgtgctccacaggccactcgcgcggcccttccctctcgccatggcgccgacggcgatgccaccgccgccgccgccgccggcgacgacgacgacggccgcatgcaacgccggtggtgtgatgttcaggacgccaagcttcatgccggtcgcgacaaataacgccagctactacccgcagcagcagacgccgttgctgtacccagggatggaagtgtgtccgcacgacaagtccacggcgcagccaccggccaccaccaccatgtacctgcaggcaccgccgagcagcgcacacctcgcggcggcggctggccgcggcgcggcggaagcggaaggccatggccgccgcggcggcggcgccggtgggcgcgagaccctccagctgttccccctgcagcccaccttcgtgctgccggatcacaagccgctccgcgccgggagcgcctgcgccgccgtgtccccgacgacgccgtccgcgtccgcgtcgttctcgtgggagtcggagagctcggacagccccagcagcgaggcgcctccgttctacgacttcttcggcgtccattctggaggccgc

SEQ ID NO: 316 - protein, 313 aa, Oryza sativa
  LOC_Os01g62310.1
METTTTTLGGGGGGRAGGFSDPPSPLSPPLSPASAAAAALANARWTPTKEQIAVLEGLYRQGLRTPTAEQIQQITARLREHGHIEGKNVFYWFQNHKARQRQKQKQQSFDYFSKLFRRPPPLPVLHRPLARPFPLAMAPTAMPPPPPPPATTTTAACNAGGVMFRTPSFMPVATNNASYYPQQQTPLLYPGMEVCPHDKSTAQPPATTTMYLQAPPSSAHLAAAAGRGAAEAEGHGRRGGGAGGRETLQLFPLQPTFVLPDHKPLRAGSACAAVSPTTPSASASFSWESESSDSPSSEAPPFYDFFGVHSGGR

SEQ ID NO: 317 - DNA, 1029 bp, Setaria italica
  Si004427m
atggaggcggcgccacagcacggcggcgccggggtcatcgaccttgagggctctggcagcggcggcgcgccgctctcgccgccgctgtccccggcctcggccgcggcggcggcgctggcgaacgcgcggtggaacccgaccaaggagcagctggccgcgctggaggggctgtacgagcacggcctgcgcacccccagcgccgagcagatcaagcagatcacggccaggctgcgcgagcacggccacatcgagggcaagaacgtcttctactggttccagaaccacaaggcccgccagcgccagaagcagaagcaggacagcttcgcctacttcaccaggctcctccgccgccccccgccgctgcccatgctcgtcagaccccccggcccgctgccgtaccctcacggccgcctccccgtcccggcgccgcccgctgctgctgctgctgcatgcagcagcagcaacggtggcacgcatgttgtcgaatggatcaatgcgtctttccttgctgcagtgatgtacaggtctccattctacatgccagcagcgccgcaggctcccgcggcgaatgctctctactaccacccgcagcaccagcatcaggttccagcgtcagtcatgtacccaaggatggaggtcgcgcaagacaagatgatcccagcagcggcgcagcacaaccaccaccaccaccgccaccacccggcggccggcgccatgtaccatgccgccgcggcggggaacaacgcgagcaccaccccgatgcacgtgctgcacttcccgccggcggcagcagtggatgctggccccagccgcgagacgctgcagctgttccctctgcagcccaccttcctgctgccggccgacaaggggcgcgccgccggcggtggtgcgtccatggcgccggcgccgtcgacggcgtccgcttcgttctcgggggagtccgagagcctggaggagagcccggactcgtacagcgaggcgctcgcggtgccgttctatgacttcttcggcctccagtccggaggccgc

SEQ ID NO: 318 - protein, 343 aa, Setaria italica
  Si004427m
MEAAPQHGGAGVIDLEGSGSGGAPLSPPLSPASAAAAALANARWNPTKEQLAALEGLYEHGLRTPSAEQIKQITARLREHGHIEGKNVFYWFQNHKARQRQKQKQDSFAYFTRLLRRPPPLPMLVRPPGPLPYPHGRLPVPAPPAAAAAACSSSNGGTHVVEWINASFLAAVMYRSPFYMPAAPQAPAANALYYHPQHQHQVPASVMYPRMEVAQDKMIPAAAQHNHHHHRHHPAAGAMYHAAAAGNNASTTPMHVLHFPPAAAVDAGPSRETLQLFPLQPTFLLPADKGRAAGGGASMAPAPSTASASFSGESESLEESPDSYSEALAVPFYDFFGLQSGGR

SEQ ID NO: 319 - DNA, 636 bp, Glycine max
  Glyma13g41000.1
atggagagtcacagtagtgatgctgaggcggagaatgtaaggactcattcatcagtttcacggtggagtcctacaaaggagcaaatagacatgttagagaacctttacaagcagggaataaggactcccagcactgagcaaatacaacagattacctctaggctcagggcttatggtcacatcgagggaaagaatgtcttctactggtttcaaaatcacaaagctcgtcaaagacagaagctgatgaagcaacaaaccattgcatattccaatcgctttcttcgtgcctcccaccccatttgccaaaatgttgcctgcgctccatattgtttgcaacggagtggattcagcttttatcctcaacaatcgaaggtgcttgcaagtggaggtataagttcaactgggcctttaggcatgcaaagaatgtttgatggcatgcagagtagtgaacacccggattgtaaccgtgaagtcttaactctctttcctcttcatccaaccggcattttgaaagaaaaaacaactcatcaagtgccttcccttgcttcaacttctgttgttgctgttgatgaagatggtcatcttggaaatcagcccttctttaattttttcactactgaaccaaggtcgagagag

SEQ ID NO: 320 - protein, 212 aa, Glycine max
  Glyma13g41000.1
MESHSSDAEAENVRTHSSVSRWSPTKEQIDMLENLYKQGIRTPSTEQIQQITSRLRAYGHIEGKNVFYWFQNHKARQRQKLMKQQTIAYSNRFLRASHPICQNVACAPYCLQRSGFSFYPQQSKVLASGGISSTGPLGMQRMFDGMQSSEHPDCNREVLTLFPLHPTGILKEKTTHQVPSLASTSVVAVDEDGHLGNQPFFNFFTTEPRSRE

SEQ ID NO: 321 - DNA, 972 bp, Zea mays
  GRMZM2G108933_T01
atggagacgccacagcagcaatccgccgccgccgccgccgccgccgcccacgggcaggacgacggcgggtcgccgccgatgtcgccggcctccgccgcggcggcggcgctggcgaacgcgcggtggaacccgaccaaggagcaggtggccgtgctggaggggctgtacgagcacggcctgcgcacccccagcgcggagcagatacagcagatcacgggcaggctgcgggagcacggcgccatcgagggcaagaacgtcttctactggttccagaaccacaaggcccgccagcgccagaggcagaagcaggacagcttcgcctacttcagcaggctcctccgccggcccccgccgctgcccgtgctctccatgccccccgcgccaccgtaccatcacgcccgcgtcccggcgccgcccgcgataccgatgccgatggcgccgccgccgcccgctgcatgcaacgacaacggcggcgcgcgtgtgatctacaggaacccattctacgtggctgcgccgcaggcgccccctgcaaatgccgcctactactacccacagccacagcagcagcagcagcagcaggtgacagtcatgtaccagtacccgagaatggaggtagccggccaggacaagatgatgaccagggccgcggcgcaccagcagcagcagcacaacggcgccgggcaacaaccgggacgcgccggccaccccagccgcgagacgctccagctgttcccgctccagcccaccttcgtgctgcggcacgacaaggggcgcgccgccaacggcagtaataacgactccctgacgtcgacgtcgacggcgactgcgacagcgacagcgacagcgacagcgtccgcttccatctccgaggactcggatggcctggagagcggcagctccggcaagggcgtcgaggaggcgcccgcgctgccgttctatgacttcttcgggctccagtcctccggaggccgc

SEQ ID NO: 322 - protein, 324 aa, Zea mays
  GRMZM2G108933_T01
METPQQQSAAAAAAAAHGQDDGGSPPMSPASAAAAALANARWNPTKEQVAVLEGLYEHGLRTPSAEQIQQITGRLREHGAIEGKNVFYWFQNHKARQRQRQKQDSFAYFSRLLRRPPPLPVLSMPPAPPYHHARVPAPPAIPMPMAPPPPAACNDNGGARVIYRNPFYVAAPQAPPANAAYYYPQPQQQQQQQVTVMYQYPRMEVAGQDKMMTRAAAHQQQQHNGAGQQPGRAGHPSRETLQLFPLQPTFVLRHDKGRAANGSNNDSLTSTSTATATATATATASASISEDSDGLESGSSGKGVEEAPALPFYDFFGLQSSGGR

SEQ ID NO: 323 - DNA, 657 bp, Glycine max
  Glyma15g04460.1
atggagagtcacagtactgcagaggatgagagtggatggaaaggatcaagtggtgctcattcatcagtttcacgatggagtcctacaaaggagcaaatagacatgttggagaacttttacaagcagggaataaggactcccagcactgagcaaatacaacagattacctctaggcttagggcttatggttacatcgagggaaaaaatgtcttctactggtttcaaaatcacaaagcgcgccaaagacagaagctcaagcagaagcaacaaagcattgcatactgcaattgctttcttcatgcctcccaccccatttgccaaaatgttgtctgcgctccatattgtttgcaaaagagtggattcagcttttatcctcaccaaccaaaggtgcttgcaagtgtaggtattagctcaaggattgagactgggtcctttggcatgctaagaatatgtgatggcatgcagagtgaacacccggattataactatagcaccagtaaccgtgaagccttaactctatttcctcttcatccaaccggtattttggaagaaaaaacaactcatcactctgttgatgtcaccgacaaatcttttgtttctattgctgttgacgaaaatggtcatcttggaaatcaaccctgctttaattttcagtac

SEQ ID NO: 324 - protein, 219 aa, Glycine max
  Glyma15g04460.1
MESHSTAEDESGWKGSSGAHSSVSRWSPTKEQIDMLENFYKQGIRTPSTEQIQQITSRLRAYGYIEGKNVFYWFQNHKARQRQKLKQKQQSIAYCNCFLHASHPICQNVVCAPYCLQKSGFSFYPHQPKVLASVGISSRIETGSFGMLRICDGMQSEHPDYNYSTSNREALTLFPLHPTGILEEKTTHHSVDVTDKSFVSIAVDENGHLGNQPCFNFQY

SEQ ID NO: 325 - DNA, 738 bp, Populus trichocarpa
  POPTR_0009s03460.1
atggatagtgatgatatggacgtggctggttctggtggagctccagggaattcaagatggaacccaacaaaggagcagattagcatgcttgagagcttctacagccaaggtatacggaccccaagtactgaaatgatagagcaaataacgagcaggcttaaagcttatggtcacatagaaggaaagaatgtattttactggtttcaaaatcacaaggcaagacaaagacagaagcagaaacaagagagcatggcttatatcaataactatcttcacaaggttcatcaacctgtgtttgcacctccttgcgcaaatgttgtctgcagcccatacttcccacaacagagcgaagtaatggggttttgtcaacaacatccgaaaatgctactccctagtaatttcaagatgaggccgaggtctgaagcaagaacctatgcttttaatggatatgaaccagcggcgccctatgggtaccacaatcgtatcacgatgaacaagggtgagaggaccctggtaaccatcaaccacaagagcagcagtgatcaagcaacgttgcctctctttcctttgcacccaacaggaactttagaaggagcaacgagtatctgtcctgtcggttcaactgatcctgctgagaattccacgaacactcctagctcctctgagattactactggcattgaagaacattctggtgattgcaaacctttctttgatttcttctatggaaaagattct

SEQ ID NO: 326 - protein, 246 aa, Populus trichocarpa
  POPTR_0009s03460.1
MDSDDMDVAGSGGAPGNSRWNPTKEQISMLESFYSQGIRTPSTEMIEQITSRLKAYGHIEGKNVFYWFQNHKARQRQKQKQESMAYINNYLHKVHQPVFAPPCANVVCSPYFPQQSEVMGFCQQHPKMLLPSNFKMRPRSEARTYAFNGYEPAAPYGYHNRITMNKGERTLVTINHKSSSDQATLPLFPLHPTGTLEGATSICPVGSTDPAENSTNTPSSSEITTGIEEHSGDCKPFFDFFYGKDS

SEQ ID NO: 327 - DNA, 735 bp, Populus trichocarpa
  POPTR_0001s24470.1
atggacgtgtctagttctggtggagcttcagtgaattcaagatggagcccaacaaaggagcagattagcatgcttgagagcttctacagccaaggtatacggaccccgagcactgaaatgatagaacaaatagcaagcaggctcaaagcctatggtcacatagaagggaaaaatgtattttactggtttcaaaatcacaaggcaaggcaaagacagaagcagaaacaagagaacatggcttatatcaataagtatcttcacaaggctcatcaacctgtgtttgcacctccttgcagaaatgttgtaaacagcccatgctacctgccaaagagcgatataatggggttgtgtcaacaacatcagaacatgctactcccaggtaatttcaagaggaggtcgagatctgaaaccataagttatgcttttaagggatatgatcaagaagccgtcctccgtgagtaccacaatcatatcacgaagaacaagtttgagaggagtccggtaaccattgacaagagcagcagtgatcaggaaactttgcctctctttccgttgcacccaacagggattctagaaggagcaagtcctattttttctcacggttcaacttctgctgagaattccattaacactccaatctcctctgagattactcatggcattggagagcattctgctgatcacaaacctttctttgatttcttctctgagaaagatcctttcgagagttctcat

SEQ ID NO: 328 - protein, 245 aa, Populus trichocarpa
  POPTR_0001s24470.1
MDVSSSGGASVNSRWSPTKEQISMLESFYSQGIRTPSTEMIEQIASRLKAYGHIEGKNVFYWFQNHKARQRQKQKQENMAYINKYLHKAHQPVFAPPCRNVVNSPCYLPKSDIMGLCQQHQNMLLPGNFKRRSRSETISYAFKGYDQEAVLREYHNHITKNKFERSPVTIDKSSSDQETLPLFPLHPTGILEGASPIFSHGSTSAENSINTPISSEITHGIGEHSADHKPFFDFFSEKDPFESSH

SEQ ID NO: 329 - protein, 50 aa, Arabidopsis thaliana
  AT4G31060.1 AP2 domain coordinates 26-75
CYRGVRKRSWGKWVSEIRVPKTGRRIWLGSYDAPEKAARAYDAALFCIRG

SEQ ID NO: 330 - protein, 50 aa, Populus trichocarpa
  POPTR_0006s08000.1 AP2 domain coordinates 21-70
TYRGVRMRTWGKWVSEIRVPKTGQRIWLGSYDAPEKAARAYDAAQYCIRG

SEQ ID NO: 331 - protein, 50 aa, Vitis vinifera
  GSVIVT01035502001 AP2 domain coordinates 24-73
KYKGVRKRKWGKWVSEIRLPNSRERIWLGSYDTPEKAARAFDAALFCLRG

SEQ ID NO: 332 - protein, 50 aa, Solanum lycopersicum
  Solyc12g009240.1.1 AP2 domain coordinates 19-68
LYRGVRKRKWGKWVSEIRLPNSRERIWLGSYDTPEKAAKAFDAALFCLRG

SEQ ID NO: 333 - protein, 50 aa, Arabidopsis thaliana
  AT1G74930.1 AP2 domain coordinates 20-69
KYKGVRKRKWGKWVSEIRLPHSRERIWLGSYDTPEKAARAFDAAQFCLRG

SEQ ID NO: 334 - protein, 50 aa, Arabidopsis thaliana
  AT1G19210.1 AP2 domain coordinates 11-60
KYKGVRKRKWGKWVSEIRLPNSRERIWLGSYDTPEKAARAFDAALYCLRG

SEQ ID NO: 335 - protein, 50 aa, Populus trichocarpa; identical to SEQ ID NO: 334
  POPTR_0006s23480.1 AP2 domain coordinates 24-73

SEQ ID NO: 336 - protein, 50 aa, Glycine max
  Glyma04g06100.1 AP2 domain coordinates 1-50
LYKGVRKRKWGKWVSEIRLPNSRERIWLGSYDSPEKAARAFDAALYCLRG

SEQ ID NO: 337 - protein, 50 aa, Glycine max; identical to SEQ ID NO: 336
  Glyma06g06100.1 AP2 domain coordinates 24-73

SEQ ID NO: 338 - protein, 50 aa, Glycine max
  Glyma17g05240.1 AP2 domain coordinates 17-66
YYKGVRKRKWGKWVSEIRLPNSRQRIWLGSYDTPEKAARAFDAAMFCLRG

SEQ ID NO: 339 - protein, 50 aa, Vitis vinifera
  GSVIVT01015037001 AP2 domain coordinates 91-140
RYKGVRKRKWGKWVSEIRLPNSRERIWLGSYDTAEKAARAFDAALYCLRG

SEQ ID NO: 340 - protein, 50 aa, Glycine max
  Glyma09g08330.1 AP2 domain coordinates 21-70
SYRGVRKRKWGKYVSEIRLPNSRQRIWLGSYDSAEKAARAFDAAMFCLRG

SEQ ID NO: 341 - protein, 50 aa, Populus trichocarpa
  POPTR_0018s08320.1 AP2 domain coordinates 19-68
KYKGVRKRKWGKWVSEIRLPNSRERIWLGSYDTPLKAARAFDAALYCLRG

SEQ ID NO: 342 - protein, 50 aa, Populus trichocarpa
  POPTR_0006s14100.1 AP2 domain coordinates 17-66
KFKGVRKRKWGKWVSEIRLPNSRERIWLGSYDSAEKAARAFDAALFCLRG

SEQ ID NO: 343 - protein, 50 aa, Glycine max
  Glyma13g17250.1 AP2 domain coordinates 18-67
YYKGVRKRKWGKWVSEIRLPNSRQRIWLGSFDTPEKAARAFDAAMFCLRG

SEQ ID NO: 344 - protein, 50 aa, Zea mays
  GRMZM2G097081_T01 AP2 domain coordinates 18-67
KFKGVRKRKWGKWVSEIRLPNSRERIWLGSYDAPDKAARAFDAAFVCLRG

SEQ ID NO: 345 - protein, 50 aa, Oryza sativa
  LOC_Os06g09717.1 AP2 domain coordinates 11-60
KYRGVRLRKWGKWVSEIRLPNSRERIWLGSYDTPEEAARAFDAAFVCLRG

SEQ ID NO: 346 - protein, 50 aa, Oryza sativa
  LOC_Os06g09760.1 AP2 domain coordinates 21-70
KYRGVRLRQWGKWVAEIRLPNSLKRIWLGSYDSPEKAARAFDAAFICLRG

SEQ ID NO: 347 - protein, 50 aa, Populus trichocarpa
  POPTR_0006s14090.1 AP2 domain coordinates 17-66
KYKGVRKRKWGRWVSEIRLPNSRERIWLGSYDSAEKAAHAFDAALFCLRG

SEQ ID NO: 348 - protein, 50 aa, Arabidopsis thaliana
  AT5G21960.1 AP2 domain coordinates 6-55
KYTGVRKRKWGKWVAEIRLPNSRDRIWLGSFDSAEKAARAFDAALYCLRG

SEQ ID NO: 349 - protein, 50 aa, Oryza sativa
  LOC_Os02g54050.1 AP2 domain coordinates 18-67
KYKGVRRRKWGKWVSEIRLPNSRDRIWLGSYDSPEKAARAFDAAFVTLRG

SEQ ID NO: 350 - protein, 50 aa, Glycine max
  Glyma15g19910.1 AP2 domain coordinates 13-62
VHVGVRKRKWGKYVSEIRLPNSRQRIWLGSYDSAEKAARAFDAAMFCLRG

SEQ ID NO: 351 - protein, 50 aa, Glycine max
  Glyma17g33530.1 AP2 domain coordinates 1-50
MFKGVRKRKWGKWVSEIRLPNSRERIWLGSYDTQVKAARAFDAALYCLRG

SEQ ID NO: 352 - protein, 50 aa, Solanum lycopersicum
  Solyc06g054630.1.1 AP2 domain coordinates 11-60
KFKGVRLRKWGKWVSEVRLPNSRDRIWLGSYDSAEKAARAFDAAQFCLRG

SEQ ID NO: 353 - protein, 50 aa, Oryza sativa
  LOC_Os06g09810.1 AP2 domain coordinates 29-78
KYKGVRLRQWGKWAAEIRLPSSCERIWLGSYDTPEKAARAFDAAFICLRG

SEQ ID NO: 354 - protein, 50 aa, Oryza sativa
  LOC_Os06g09790.1 AP2 domain coordinates 15-64
RYKGVRLRQWGKWVAEIRLPNSRKRIWLGSYYTPEKAARAFDAAFICLRG

SEQ ID NO: 355 - protein, 50 aa, Oryza sativa
  LOC_Os08g35240.1 AP2 domain coordinates 26-75
RYKGVRLRKWGRWVSEIRMPNSRERIWLGSYESAEKAARAFDAAAVCLRG

SEQ ID NO: 356 - protein, 50 aa, Oryza sativa
  LOC_Os06g11940.1 AP2 domain coordinates 31-80
KYKGVRLRQWGKWVAEIRLPNSRERVWLGSYDTPEKAARAFDAAFVFLRG

SEQ ID NO: 357 - protein, 50 aa, Brachypodium distachyon
  Bradi3g37544.1 AP2 domain coordinates 15-64
RYKGVRLRKWGRWVSEIRMPNSRERIWLGSYESAEKAALAFDAAAVCLRG

SEQ ID NO: 358 - protein, 50 aa, Zea mays
  GRMZM2G163745_T01 AP2 domain coordinates 24-73
RYKGVRLRKWGRWVSEIRMPNSRERVWLGSYESAEKAARAFDAAAVCLRG

SEQ ID NO: 359 - protein, 58 aa, Arabidopsis thaliana
  AT1G59640.1 HLH domain coordinates 140-197
RGQATDSHSLAERARREKISERMKILQDLVPGCNKVIGKALVLDEIINYIQSLQRQVE

SEQ ID NO: 360 - protein, 58 aa, Glycine max; identical to SEQ ID NO: 359
  Glyma04g34660.1 HLH domain coordinates 118-175

SEQ ID NO: 361 - protein, 58 aa, Glycine max; identical to SEQ ID NO: 359
  Glyma06g20000.1 HLH domain coordinates 143-200

SEQ ID NO: 362 - protein, 58 aa, Populus trichocarpa; identical to SEQ ID NO: 359
  POPTR_0010s04920.1 HLH domain coordinates 119-176

SEQ ID NO: 363 - protein, 58 aa, Glycine max
  Glyma01g04610.1 HLH domain coordinates 141-198
RGQATDSHSLAERARREKISERMKILQDIVPGCNKVIGKALVLDEIINYIQSLQRQVE

SEQ ID NO: 364 - protein, 58 aa, Oryza sativa
  LOC_Os07g09590.1 HLH domain coordinates 132-189
RGQATDSHSLAERARREKISERMKILQDLVPGCNKVIGKASVLDEIINYIQSLQHQVE

SEQ ID NO: 365 - protein, 58 aa, Setaria italica
  Si030790m HLH domain coordinates 145-202
RGQATDSHSLAERARREKISERMKVLQDLVPGCNKVIGKASVLDEIINYIQSLQRQVE

SEQ ID NO: 366 - protein, 58 aa, Solanum lycopersicum
  Solyc04g005130.2.1 HLH domain coordinates 104-161
RGQATDSHSLAERARREKISDRMKILQDLVPGCNKVIGKALVLDEIINYVQSLQRQVE

SEQ ID NO: 367 - protein, 58 aa, Glycine max
  Glyma17g10290.1 HLH domain coordinates 104-161
RGQATDSHSLAERARREKISERMKILQDIVPGCNKVIGKALVLDEIINYIQSLQHQVE

SEQ ID NO: 368 - protein, 58 aa, Populus trichocarpa
  POPTR_0008s19510.1 HLH domain coordinates 145-202
RGQATDSHSLAERARREKISERMKILQDIVPGCNKVTGKALVLDEIINYIQSLQRQVE

SEQ ID NO: 369 - protein, 58 aa, Eucalyptus grandis
  Eucgr.K02908.1 HLH domain coordinates 152-209
RGQATDSHSLAERARREKISERMKILQDLVPGCNKVIGKALILDEIINYIQSLQNQVE

SEQ ID NO: 370 - protein, 58 aa, Oryza sativa
  LOC_Os03g58830.1 HLH domain coordinates 140-197
RGQATDSHSLAERARREKISERMKILQDLVPGCNKVIGKASVLDEIINYIQALQRQVE

SEQ ID NO: 371 - protein, 58 aa, Setaria italica
  Si037131m HLH domain coordinates 130-187
RGQATDSHSLAERARREKISERMKVLQDLVPGCNKVIGKASVLDEIINYIQSLQCQVE

SEQ ID NO: 372 - protein, 58 aa, Glycine max
  Glyma05g01590.1 HLH domain coordinates 103-160
RGQATDNHSLAERARREKISERMKILQDLVPGCNKVIGKAFVLDEIINYVQSLQRQVE

SEQ ID NO: 373 - protein, 58 aa, Solanum lycopersicum
  Solyc05g006650.2.1 HLH domain coordinates 150-207
RGQATDSHSLAERARREKISERMKVLQDIVPGCNKVIGKALVLDEIINYIQSLQHQVE

SEQ ID NO: 374 - protein, 58 aa, Eucalyptus grandis
  Eucgr.B03392.1 HLH domain coordinates 154-211
RGQATDSHSLAERARREKISERMKILQDIVPGCNKVIGRALVLDEIINYIQSLQHQVE

SEQ ID NO: 375 - protein, 58 aa, Zea mays; identical to SEQ ID NO: 371
  GRMZM2G137358_T01 HLH domain coordinates 130-187

SEQ ID NO: 376 - protein, 58 aa, Eucalyptus grandis
  Eucgr.B00385.1 HLH domain coordinates 146-203
RGQATDSHSLAERARREKISERMKTLQDLVPGCNKIIGKALVLDEIINYIQSLQHQVE

SEQ ID NO: 377 - protein, 58 aa, Populus trichocarpa
  POPTR_0015s07930.1 HLH domain coordinates 149-206
RGQATDSHSLAERARREKISERMNMLQDLVPGCNKVIGKALVLDEIINYIQSLQCQVE

SEQ ID NO: 378 - protein, 58 aa, Zea mays
  GRMZM2G008898_T01 HLH domain coordinates 127-184
RGQATDSHSLAERARREKISERMKVLQDIVPGCNKVIGKASVLDEIINYIQSLQRQVE

SEQ ID NO: 379 - protein, 58 aa, Populus trichocarpa
  POPTR_0012s07470.1 HLH domain coordinates 147-204
RGQATDSHSLAERARRERIGERMKILQDLVPGCNKVIGKALALDEIINYIQSLQCQVE

SEQ ID NO: 380 - protein, 58 aa, Arabidopsis thaliana
  AT5G62610.1 HLH domain coordinates 157-214
RGQATDRHSLAERARREKISEKMTALQDIIPGCNKIIGKALVLDEIINYIQSLQRQVE

SEQ ID NO: 381 - protein, 65 aa, Arabidopsis thaliana
  NF-YC8 CBF/NF-Y domain coordinates 35-99
HDLPITRIKKIMKYDPDVTMIASEAPILLSKACEMFIMDLTMRSWLHAQESKRVTLQKSNVDAAV

SEQ ID NO: 382 - protein, 65 aa, Arabidopsis thaliana
  AT5G50490.1 CBF/NF-Y domain coordinates 35-99
HEFPISRIKRIMKFDPDVSMIAAEAPNLLSKACEMFVMDLTMRSWLHAQESNRLTIRKSDVDAVV

SEQ ID NO: 383 - protein, 65 aa, Arabidopsis thaliana
  AT5G50480.1 CBF/NF-Y domain coordinates 53-117
RQLPLARIKKIMKADPDVHMVSAEAPIIFAKACEMFIVDLTMRSWLKAEENKRHTLQKSDISNAV

SEQ ID NO: 384 - protein, 65 aa, Solanum lycopersicum
  Solyc03g111470.1.1 CBF/NF-Y domain coordinates 74-138
HSLPIFRIKKIMKSDKEVRMISAESPILLDKACELFIQELTHRSWLKAQECQRRTLKKIDFFTTE

SEQ ID NO: 385 - protein, 65 aa, Solanum lycopersicum
  Solyc03g111460.1.1 CBF/NF-Y domain coordinates 64-128
HSLPISRIKKIMKSDKEVRMISAESPILLAKACELFIQELTHRSWLKAQECQRQTLKKIDLFTVL

SEQ ID NO: 386 - protein, 71 aa, Arabidopsis thaliana
  AT5G50470.1 CBF/NF-Y domain coordinates 62-132
HAFPLTRIKKIMKSNPEVNMVTAEAPVLISKACEMLILDLTMRSWLHTVEGGRQTLKRSDTLTRSDISAAT

SEQ ID NO: 387 - protein, 66 aa, Solanum lycopersicum
  Solyc03g110850.1.1 CBF/NF-Y domain coordinates 53-118
NLLPRIHRIKKIMKTDKDVRMIATESPVLLAKACELFIQELTLRSWFKAEENHRRILKKDDVTDVI

SEQ ID NO: 388 - protein, 66 aa, Solanum lycopersicum
  Solyc03g110840.1.1 CBF/NF-Y domain coordinates 52-117
RLLLPPTRIKKIMKKNEDVRMVAGESPVLLAKACELFIQDLTLRSSIHAQENHRRILKKDDLTDVI

SEQ ID NO: 389 - protein, 66 aa, Solanum lycopersicum
  Solyc11g016920.1.1 CBF/NF-Y domain coordinates 53-118
NLLPSINRIKKIMKTDKDVRMIATESPVLLAKACELFIQELTLRSWFKTEKNHRRILKKDDVTDVI

SEQ ID NO: 390 - protein, 66 aa, Solanum lycopersicum
  Solyc02g021330.1.1 CBF/NF-Y domain coordinates 54-119
NHLLPPNLIKKLMKTDEDDQMIAAESPVLLAKTCELFIQELTLRSWLNAQEKHQHILKKDDVTDVI

SEQ ID NO: 391 - protein, 66 aa, Solanum lycopersicum
  Solyc00g107050.1.1 CBF/NF-Y domain coordinates 55-120
NLLVSPNRIKNIMKTNKDVRRITSESPVLLAKACDFFIQELTLRSWLNAQENHRRILKKKDVTDVI

SEQ ID NO: 392 - protein, 65 aa, Solanum lycopersicum
  Solyc03g111450.1.1 CBF/NF-Y domain coordinates 102-166
HHFPISRIKRIIKSENNAIKLSAETPILFSKACELFVLELTLRSWFHAQQNNRGSLKKTDFAAAI

SEQ ID NO: 393 - protein, 66 aa, Glycine max
  Glyma02g09860.1 CBF/NF-Y domain coordinates 4-69
QQKLPLARIRRMMKSEPGVQMISSEIPMLMSKACEIFIQELTFRAWMHAEKNNKSIVQPCDVAKVI

SEQ ID NO: 394 - protein, 65 aa, Oryza sativa
  LOC_Os01g24460.1 CBF/NF-Y domain coordinates 42-106
HMIPMARLKKIVSSQKGNMMMTFDMPAFLSKMCELFVQELAARAWACAQSHNRCIILDMDIAEAV

SEQ ID NO: 395 - protein, 65 aa, Oryza sativa
  LOC_Os01g01290.1 CBF/NF-Y domain coordinates 42-106
HAIPMARLKKIASSQKGNMMMSFDMPAFLSKMCELFVQELAVRAWASAQSHNRCIILDTDIAEAI

SEQ ID NO: 396 - protein, 65 aa, Oryza sativa
  LOC_Os01g39850.1 CBF/NF-Y domain coordinates 42-106
HAIPMARLKKIVSSQKGNMMMTFDMPAFLSKMCELFVQELAVRAWASAQSHNRCIILDTDIAKAI

SEQ ID NO: 397 - protein, 17 aa, Arabidopsis thaliana
  GATA4 unk. domain coordinates 70-86
PSDDAAHLEWLSRFVDD

SEQ ID NO: 398 - protein, 17 aa, Arabidopsis thaliana
  AT2G45050.1 unk. domain coordinates 72-88
PSDDAAHLEWLSQFVDD

SEQ ID NO: 399 - protein, 17 aa, Vitis vinifera
  GSVIVT01018180001 unk. domain coordinates 72-88
PSDDVAELEWLSNFVDD

SEQ ID NO: 400 - protein, 17 aa, Citrus clementina
  clementine0.9_018978m unk. domain coordinates 76-92
PSDDVAELEWLSQFVDD

SEQ ID NO: 401 - protein, 17 aa, Solanum lycopersicum
  Solyc01g090760.2.1 unk. domain coordinates 76-92
PSDDVAELEWLSNFVED

SEQ ID NO: 402 - protein, 17 aa, Glycine max
  Glyma07g14750.1 unk. domain coordinates 57-73
PTDEAAELEWLSQFVDD

SEQ ID NO: 403 - protein, 17 aa, Solanum lycopersicum
  Solyc10g018560.1.1 unk. domain coordinates 73-89
PSDDVAELEWLSNFVED

SEQ ID NO: 404 - protein, 17 aa, Zea mays
  GRMZM2G113098_T01 unk. domain coordinates 131-147
PSEEAAELEWLSKFVDD

SEQ ID NO: 405 - protein, 17 aa, Oryza sativa
  LOC_Os10g40810.1 unk. domain coordinates 138-154
PTEDAAELEWLSKFVDD

SEQ ID NO: 406 - protein, 17 aa, Setaria italica
  Si036273m unk. domain coordinates 124-140
PSEEAAELEWLSKFVDD

SEQ ID NO: 407 - protein, 17 aa, Zea mays
  GRMZM2G110295_T01 unk. domain coordinates 130-146
PSEEAAELEWLSKFVDD

SEQ ID NO: 408 - protein, 17 aa, Brachypodium distachyon
  Bradi3g33200.1 unk. domain coordinates 123-139
PSEEAAELEWLSKFVDD

SEQ ID NO: 409 - protein, 17 aa, Populus trichocarpa
  POPTR_0014s05760.1 unk. domain coordinates 79-95
PTDDVAELEWLSQFVED

SEQ ID NO: 410 - protein, 17 aa, Populus trichocarpa
  POPTR_0002s14380.1 unk. domain coordinates 77-93
PSDDVAELEWLSQFMED

SEQ ID NO: 411 - protein, 17 aa, Glycine max
  Glyma03g27250.1 unk. domain coordinates 59-75
PSDEAVELEWLSQFVND

SEQ ID NO: 412 - protein, 17 aa, Brachypodium distachyon
  Bradi1g78540.1 unk. domain coordinates 133-149
PREEAAELEWLSNFVDD

SEQ ID NO: 413 - protein, 17 aa, Zea mays
  GRMZM2G101058_T01 unk. domain coordinates 130-146
PTEEAAELEWLSKFVDD

SEQ ID NO: 414 - protein, 17 aa, Citrus clementina
  clementine0.9_015262m unk. domain coordinates 112-128
PYDDLAELEWLSNFVED

SEQ ID NO: 415 - protein, 69 aa, Arabidopsis thaliana
  GATA4 GATA-ZF domain coordinates 158-226
RRCTHCASEKTPQWRTGPLGPKTLCNACGVRYKSGRLVPEYRPASSPTFVLTQHSNSHRKVMELRRQKE

SEQ ID NO: 416 - protein, 69 aa, Arabidopsis thaliana
  AT2G45050.1 GATA-ZF domain coordinates 179-247
RRCTHCASEKTPQWRTGPLGPKTLCNACGVRFKSGRLVPEYRPASSPTFVLTQHSNSHRKVMELRRQKE

SEQ ID NO: 417 - protein, 69 aa, Citrus clementina
  clementine0.9_018978m GATA-ZF domain coordinates 165-233
RRCTHCASEKTPQWRTGPLGPKTLCNACGVRYKSGRLVPEYRPASSPTFVLTQHSNSHRKVLELRRQKE

SEQ ID NO: 418 - protein, 69 aa, Solanum lycopersicum
  Solyc01g090760.2.1 GATA-ZF domain coordinates 165-233
RRCTHCASEKTPQWRTGPLGPKTLCNACGVRYKSGRLVPEYRPAASPTFVLTQHSNSHRKVMELRRQKE

SEQ ID NO: 419 - protein, 69 aa, Vitis vinifera
  GSVIVT01018180001 GATA-ZF domain coordinates 155-223
RKCTHCASEKTPQWRTGPLGPKTLCNACGVRYKSGRLVPEYRPAASPTFVLTQHSNSHRKVMELRRQKE

SEQ ID NO: 420 - protein, 69 aa, Populus trichocarpa
  POPTR_0002s14380.1 GATA-ZF domain coordinates 161-229
RRCTHCASEKTPQWRTGPLGPKTLCNACGVRYKSGRLVPEYRPAASPTFVLTQHSNSHRKVLELRRQKE

SEQ ID NO: 421 - protein, 69 aa, Solanum lycopersicum; identical to SEQ ID NO: 419
  Solyc10g018560.1.1 GATA-ZF domain coordinates 170-238

SEQ ID NO: 422 - protein, 69 aa, Brachypodium distachyon
  Bradi1g78540.1 GATA-ZF domain coordinates 254-322
RRCTHCASEKTPQWRTGPLGPKTLCNACGVRYKSGRLVPEYRPAASPTFVLTQHSNSHRKVMELRRQNE

SEQ ID NO: 423 - protein, 69 aa, Zea mays
  GRMZM2G113098_T01 GATA-ZF domain coordinates 259-327
RRCTHCASEKTPQWRTGPLGPKTLCNACGVRFKSGRLVPEYRPAASPTFVLTQHSNSHRKVMELRRQKE

SEQ ID NO: 424 - protein, 69 aa, Zea mays
  GRMZM2G110295_T01 GATA-ZF domain coordinates 273-341
RRCTHCASETTPQWRTGPLGPKTLCNACGVRFKSGRLVPEYRPASSPTFVLTQHSNSHRKVMELRRQKE

SEQ ID NO: 425 - protein, 69 aa, Populus trichocarpa
  POPTR_0014s05760.1 GATA-ZF domain coordinates 163-231
RRCTHCASEKTPQWRTGPLGPKTLCNACGVRYKSGRLVPEYRPAASPTFVLTRHSNSHRKVLELRRQKE

SEQ ID NO: 426 - protein, 69 aa, Oryza sativa
  LOC_Os10g40810.1 GATA-ZF domain coordinates 276-344
RRCTHCASEKTPQWRTGPLGPKTLCNACGVRFKSGRLMPEYRPAASPTFVLTQHSNSHRKVMELRRQKE

SEQ ID NO: 427 - protein, 69 aa, Setaria italica; identical to SEQ ID NO: 426
  Si036273m GATA-ZF domain coordinates 260-328

SEQ ID NO: 428 - protein, 69 aa, Zea mays; identical to SEQ ID NO: 426
  GRMZM2G101058_T01 GATA-ZF domain coordinates 273-341

SEQ ID NO: 429 - protein, 69 aa, Brachypodium distachyon
  Bradi3g33200.1 GATA-ZF domain coordinates 260-328
RRCTHCASEKTPQWRTGPLGPKTLCNACGVRFKSGRLVPEYRPAASPTFLLTQHSNSHRKVMELRRQKE

SEQ ID NO: 430 - protein, 69 aa, Glycine max
  Glyma07g14750.1 GATA-ZF domain coordinates 141-209
RRCSHCASEKTPQWRAGPLGPKTLCNACGVRFKSGRLVPEYRPAASPTFVLTQHSNSHRKVMELRRQKE

SEQ ID NO: 431 - protein, 69 aa, Glycine max
  Glyma03g27250.1 GATA-ZF domain coordinates 137-205
RRCSHCATDKTPQWRTGPLGPKTLCNACGVRFKSGRLVPEYRPAASPTFVMTQHSNSHRKVMELRRQKE

SEQ ID NO: 432 - protein, 69 aa, Citrus clementina
  clementine0.9_015262m GATA-ZF domain coordinates 227-295
RKCLHCASEKTPQWRTGPMGPKTLCNACGVRYKSGRLVPEYRPAASPTFVSAKHSNSHRKVMELRRQKE

SEQ ID NO: 433 - protein, 65 aa, Arabidopsis thaliana
  WUS homeodomain domain coordinates 35-99
TSTRWTPTTEQIKILKELYYNNAIRSPTADQIQKITARLRQFGKIEGKNVFYWFQNHKARERQKK

SEQ ID NO: 434 - protein, 65 aa, Eucalyptus grandis
  Eucgr.J02429.1 homeodomain domain coordinates 41-105
SSTRWTPTTDQIRILKDLYYNYGVRSPTADQIQRISARLRQYGKIEGKNVFYWFQNHKARERQKK

SEQ ID NO: 435 - protein, 65 aa, Glycine max
  Glyma01g37190.1 homeodomain domain coordinates 35-99
SSTRWTPTNDQIRILKELYYNNGIRSPSAEQIQRISARLRQYGKIEGKNVFYWFQNHKARERQKK

SEQ ID NO: 436 - protein, 65 aa, Glycine max
  Glyma11g08090.1 homeodomain domain coordinates 31-95
SSTRWTPTNDQIRILKDLYYNNGIRSPSAEQIQRISARLRQYGKIEGKNVFYWFQNHKARERQKK

SEQ ID NO: 437 - protein, 65 aa, Vitis vinifera
  GSVIVT01018787001 homeodomain domain coordinates 34-98
SSTRWTPTTDQIRILKDLYYNNGVRSPSAEQIQRISARLRQYGKIEGKNVFYWFQNHKARERQKK

SEQ ID NO: 438 - protein, 65 aa, Citrus clementina
  clementine0.9_033636m homeodomain domain coordinates 30-94
TCPRWTPTTDQIRILKELYYNNGVRSPTAEQIQKISARLRQYGKIEGKNVFYWFQNYKARERLKK

SEQ ID NO: 439 - protein, 65 aa, Solanum lycopersicum
  Solyc02g083950.2.1 homeodomain domain coordinates 23-87
SSSRWTPTSDQIRILKDLYYNNGVRSPTAEQIQRISAKLRQYGKIEGKNVFYWFQNHKARERQKK

SEQ ID NO: 440 - protein, 65 aa, Oryza sativa
  LOC_Os04g56780.1 homeodomain domain coordinates 32-96
SGTRWTPTTEQIKILRELYYSCGIRSPNSEQIQRIAAMLRQYGRIEGKNVFYWFQNHKARERQKK

SEQ ID NO: 441 - protein, 65 aa, Populus trichocarpa
  POPTR_0005s11680.1 homeodomain domain coordinates 31-95
TSTRWTPTTDQIRILKELYYIKGVRSPNGAEIQQISARLRKYGKIEGKNVFYWFQNHKARERQKK

SEQ ID NO: 442 - protein, 65 aa, Populus trichocarpa; identical to SEQ ID NO: 441
  POPTR_0005s11680.2 homeodomain domain coordinates 31-95

SEQ ID NO: 443 - protein, 65 aa, Setaria italica
  Si024219m homeodomain domain coordinates 31-95
SGSRWTPTPEQIRILKELYYGCGIRSPNSEQIQRITAMLRQHGKIEGKNVFYWFQNHKARERQKR

SEQ ID NO: 444 - protein, 65 aa, Zea mays; identical to SEQ ID NO: 443
  GRMZM2G047448_T01 homeodomain domain coordinates 37-101

SEQ ID NO: 445 - protein, 65 aa, Populus trichocarpa
  POPTR_0007s14130.1 homeodomain domain coordinates 25-89
TSTRWNPTTDQIRILKELYYIKGVRSPNGAEIQQISARLRKYGKIEGKNVFYWFQNHKARERQKK

SEQ ID NO: 446 - protein, 65 aa, Populus trichocarpa; identical to SEQ ID NO: 445
  POPTR_0007s14130.2 homeodomain domain coordinates 25-89

SEQ ID NO: 447 - protein, 65 aa, Zea mays
  GRMZM2G028622_T01 homeodomain domain coordinates 28-92
SGSRWTPTPEQIRMLKELYYGCGIRSPSSEQIQRITAMLRQHGKIEGKNVFYWFQNHKARERQKR

SEQ ID NO: 448 - protein, 61 aa, Arabidopsis thaliana
  ERF054 AP2 domain coordinates 141-201
KLYRGVRQRQWGKWVAEIRKPRSRARLWLGTFDTAEEAAMAYDRQAFKLRGHSATLNFPEH

SEQ ID NO: 449 - protein, 61 aa, Arabidopsis thaliana
  AT2G20880.1 AP2 domain coordinates 185-245
KLYRGVRQRHWGKWVAEIRKPRNRTRLWLGTFDTAEEAAMAYDREAFKLRGETARLNFPEL

SEQ ID NO: 450 - protein, 61 aa, Solanum lycopersicum
  Solyc07g054220.1.1 AP2 domain coordinates 179-239
KLYRGVRQRHWGKWVAEIRLPRNRTRLWLGTFDTAEDAAMAYDREAYKLRGDNAKLNFPEH

SEQ ID NO: 451 - protein, 61 aa, Glycine max
  Glyma06g45010.1 AP2 domain coordinates 206-266
KLYRGVRQRHWGKWVAEIRLPRNRTRLWLGTFDTAEDAAMAYDREAFKLRGENAKLNFPEL

SEQ ID NO: 452 - protein, 61 aa, Glycine max; identical to SEQ ID NO: 451
  Glyma12g12270.1 AP2 domain coordinates 188-248

SEQ ID NO: 453 - protein, 61 aa, Glycine max
  Glyma12g33020.1 AP2 domain coordinates 206-266
KLYRGVRQRHWGKWVAEIRLPRNRTRLWLGTFDTAEDAAMAYDREAFKLRGENARLNFPEL

SEQ ID NO: 454 - protein, 61 aa, Zea mays
  GRMZM2G300924_T01 AP2 domain coordinates 211-271
KLYRGVRQRHWGKWVAEIRLPRNRTRLWLGTFDTAEDAAMAYDREAFKLRGDNARLNFPDL

SEQ ID NO: 455 - protein, 61 aa, Setaria italica
  Si019997m AP2 domain coordinates 217-277
KLYRGVRQRHWGKWVAEIRLPRNRTRLWLGTFDTAEDAAMAYDREAFKLRGENAKLNFPDL

SEQ ID NO: 456 - protein, 61 aa, Brachypodium distachyon
  Bradi3g49810.1 AP2 domain coordinates 182-242
KLYRGVRQRHWGKWVAEIRLPRNRTRLWLGTFDTAEDAAMAYDREAFKLRGENARLNFPDL

SEQ ID NO: 457 - protein, 61 aa, Zea mays; identical to SEQ ID NO: 455
  GRMZM2G139765_T01 AP2 domain coordinates 206-266

SEQ ID NO: 458 - protein, 61 aa, Eucalyptus grandis
  Eucgr.K00961.1 AP2 domain coordinates 236-296
KLYRGVRQRHWGKWVAEIRLPRNRTRLWLGTFDTAEDAALAYDREAFKLRGENARLNFPEL

SEQ ID NO: 459 - protein, 61 aa, Populus trichocarpa; identical to SEQ ID NO: 458
  POPTR_0013s13920.1 AP2 domain coordinates 230-290

SEQ ID NO: 460 - protein, 61 aa, Glycine max
  Glyma13g37450.1 AP2 domain coordinates 147-207
KLYRGVRQRHWGKWVAEIRLPRNRTRLWLGTFDTAEDAAMAYDREAFKQRGENARLNFPEL

SEQ ID NO: 461 - protein, 61 aa, Oryza sativa
  LOC_Os04g44670.1 AP2 domain coordinates 213-273
KLYRGVRQRHWGKWVAEIRLPRNRTRLWLGTFDTAEDAAMAYDREAFKLRGENARLNFPDR

SEQ ID NO: 462 - protein, 61 aa, Oryza sativa; identical to SEQ ID NO: 456
  LOC_Os02g42585.1 AP2 domain coordinates 224-284

SEQ ID NO: 463 - protein, 61 aa, Brachypodium distachyon
  Bradi5g16450.1 AP2 domain coordinates 217-277
KLYRGVRQRHWGKWVAEIRLPRNRTRLWLGTFDSAEDAAMAYDREAFKLRGENARLNFPDR

SEQ ID NO: 464 - protein, 61 aa, Populus trichocarpa
  POPTR_0019s13330.1 AP2 domain coordinates 230-290
KLYRGVRQRHWGKWVAEIRLPRNRTRLWLGTFDNAEDAALAYDREAFKLRGENAKLNFPEL

SEQ ID NO: 465 - protein, 61 aa, Zea mays
  GRMZM2G040664_T01 AP2 domain coordinates 173-233
KLYRGVRQRHWGKWVAEIRLPRDRTRLWLGTFDSAEDAAMAYDREAFKLRGENARLNFPDR

SEQ ID NO: 466 - protein, 61 aa, Citrus clementina
  clementine0.9_009464m AP2 domain coordinates 218-278
KLYRGVRQRHWGKWVAEIRLPRNRTRLWLGTFDRAEDAALAYDREAFKLRGENARLNFPEL

SEQ ID NO: 467 - protein, 61 aa, Zea mays; identical to SEQ ID NO: 463
  GRMZM2G026926_T01 AP2 domain coordinates 212-272

SEQ ID NO: 468 - protein, 61 aa, Setaria italica; identical to SEQ ID NO: 463
  Si012169m AP2 domain coordinates 212-272

SEQ ID NO: 469 - protein, 51 aa, Arabidopsis thaliana
  G1135 bHLH domain coordinates 373-423
KNLMAERRRRKKLNDRLYALRSLVPRITKLDRASILGDAINYVKELQNEAK

SEQ ID NO: 470 - protein, 51 aa, Arabidopsis thaliana; identical to SEQ ID NO: 469
  AMS bHLH domain coordinates 314-364

SEQ ID NO: 471 - protein, 51 aa, Populus trichocarpa
  POPTR_0009s13860.1 bHLH domain coordinates 324-374
KNLVAERKRRKKLNDRLYALRSLVPNISKLDRASILGDAIEFVKELQKEAK

SEQ ID NO: 472 - protein, 51 aa, Vitis vinifera
  GSVIVT01013720001 bHLH domain coordinates 308-358
KNLVAERRRRKKLNDRLYALRALVPKISKLDRASILGDAIEFVKELQKQAK

SEQ ID NO: 473 - protein, 51 aa, Vitis vinifera
  GSVIVT01024008001 bHLH domain coordinates 331-381
KNIDAERRRRKKLNDRLYALRSLVPKISKLDRASILGDAIEFVKELQKQAK

SEQ ID NO: 474 - protein, 51 aa, Glycine max
  Glyma10g42830.1 bHLH domain coordinates 334-384
KNLVAERKRRKKLNDRLYNLRSLVPRISKLDRASILGDAIEYVKDLQKQVK

SEQ ID NO: 475 - protein, 51 aa, Glycine max; identical to SEQ ID NO: 474
  Glyma20g24170.1 bHLH domain coordinates 292-342

SEQ ID NO: 476 - protein, 51 aa, Eucalyptus grandis
  Eucgr.G01783.1 bHLH domain coordinates 308-358
KNLQAERRRRKKLNDRLYNLRSLVPKISKLDRASILGDAIEYIMELQKQAK

SEQ ID NO: 477 - protein, 51 aa, Citrus clementina
  clementine0.9_030440m bHLH domain coordinates 328-378
KNLVAERKRRKKLNDRLYALRALVPIITKLDRATILVDAIEYVKQLQKQEK

SEQ ID NO: 478 - protein, 51 aa, Brachypodium distachyon
  Bradi3g01910.1 bHLH domain coordinates 287-337
KNLMAERKRRKKLNDRLYKLRSLVPNITKMDRASILGDAIDYIVGLQKQVK

SEQ ID NO: 479 - protein, 51 aa, Solanum lycopersicum
  Solyc08g062780.1.1 bHLH domain coordinates 327-377
KNLMAERKRRKKLNERLYALRALVPKISKLDRASILGDAIEYVMELEKQVK

SEQ ID NO: 480 - protein, 51 aa, Brachypodium distachyon
  Bradi3g01901.1 bHLH domain coordinates 284-334
KNLMAERNRRKKLNDRLYKLRSLVPNITKMDRAAILGDAIDYIVGLQKQVK

SEQ ID NO: 481 - protein, 51 aa, Setaria italica
  Si019518m bHLH domain coordinates 286-336
KNLVAERKRRKKLNERLYKLRSLVPNITKMDRASILGDAIDYIVGLQNQVK

SEQ ID NO: 482 - protein, 51 aa, Zea mays
  GRMZM2G139372_T02 bHLH domain coordinates 295-345
KNLEAERKRRKKLNERLYKLRSLVPNISKMDRAAILGDAIDYIVGLQNQVK

SEQ ID NO: 483 - protein, 51 aa, Setaria italica
  Si006199m bHLH domain coordinates 290-340
KNLVAERKRRQKLNNALYKLRSLVPKITKMDRASILGDAIDYIVGLQNQVK

SEQ ID NO: 484 - protein, 51 aa, Oryza sativa
  LOC_Os02g02820.1 bHLH domain coordinates 285-335
KNLEAERKRRKKLNGHLYKLRSLVPNITKMDRASILGDAIDYIVGLQKQVK

SEQ ID NO: 485 - protein, 51 aa, Citrus clementina
  clementine0.9_032563m bHLH domain coordinates 287-337
KNLITERNRRNKLKDGLFALRALVPKISKMDRAAILGDAAEYIKELLQEVD

SEQ ID NO: 486 - protein, 51 aa, Populus trichocarpa
  POPTR_0008s19390.1 bHLH domain coordinates 295-345
KNLVTERNRRTRIKTGLFALRALVPKISKMDKAAILGDAIDYVGELLKEVK

SEQ ID NO: 487 - protein, 63 aa, Arabidopsis thaliana
  WOX1 homeodomain domain coordinates 73-135
VSSRWNPTPDQLRVLEELYRQGTRTPSADHIQQITAQLRRYGKIEGKNVFYWFQNHKARERQK

SEQ ID NO: 488 - protein, 63 aa, Eucalyptus grandis
  Eucgr.B00945.1 homeodomain domain coordinates 77-139
VSSRWNPTPEQLRTLEELYRRGTRTPNADQIQQITAQLRRYGKIEGKNVFYWFQNHKARERQK

SEQ ID NO: 489 - protein, 63 aa, Glycine max
  Glyma08g05830.1 homeodomain domain coordinates 80-142
VSSRWNPTPEQLRALEELYRRGTRTPSAEQIQQITAQLRRFGKIEGKNVFYWFQNHKARERQK

SEQ ID NO: 490 - protein, 63 aa, Glycine max; identical to SEQ ID NO: 489
  Glyma05g33850.1 homeodomain domain coordinates 78-140

SEQ ID NO: 491 - protein, 63 aa, Vitis vinifera
  GSVIVT01008424001 homeodomain domain coordinates 75-137
VSSRWNPTPEQLRTLEELYRRGTRTPSAEQIQHITAQLRRYGKIEGKNVFYWFQNHKARERQK

SEQ ID NO: 492 - protein, 63 aa, Solanum lycopersicum
  Solyc03g118770.2.1 homeodomain domain coordinates 74-136
VSSRWNPTPEQLQTLEELYRRGTRTPSAEQIQHITAQLRRYGKIEGKNVFYWFQNHKARERQK

SEQ ID NO: 493 - protein, 63 aa, Glycine max
  Glyma07g11370.1 homeodomain domain coordinates 79-141
VSSRWNPTPEQLRALEELYRRGTRTPSAEQIQHITAQLRRFGNIEGKNVFYWFQNHKARERQK

SEQ ID NO: 494 - protein, 63 aa, Populus trichocarpa
  POPTR_0012s04510.1 homeodomain domain coordinates 88-150
MSSRWNPTPEQLRTLEELYRRGTRTPSTDQIQDITAQLRRYGRIEGKNVFYWFQNHKARERQK

SEQ ID NO: 495 - protein, 63 aa, Glycine max
  Glyma09g30830.1 homeodomain domain coordinates 16-78
VSSRWNPSPEQLRALEELYRRGTRTPSAEQIQHITAQLRRFGNIEGKNVFYWFQNHKARERQK

SEQ ID NO: 496 - protein, 63 aa, Populus trichocarpa
  POPTR_0015s04520.1 homeodomain domain coordinates 93-155
MSSRWNPTPEQLRTLEDLYRRGTRTPSTDQIQDITAQLRRYGRIEGKNVFYWFQNHKARERQK

SEQ ID NO: 497 - protein, 63 aa, Vitis vinifera
  GSVIVT01011738001 homeodomain domain coordinates 83-145
GSSRWNPTPEQLQALEELYRRGTRTPTAEQIQQIAAQLRLFGKIEGKNVFYWFQNHKARERQK

SEQ ID NO: 498 - protein, 63 aa, Glycine max
  Glyma20g02160.1 homeodomain domain coordinates 65-127
QSTRWSPTPVQLLVLEELYRQGTKTPSAEQIQQIASQLRQFGKIEGKNVFYWFQNHKARERQK

SEQ ID NO: 499 - protein, 63 aa, Arabidopsis thaliana
  AT5G59340.1 homeodomain domain coordinates 11-73
SSSRWNPTKDQITLLENLYKEGIRTPSADQIQQITGRLRAYGHIEGKNVFYWFQNHKARQRQK

SEQ ID NO: 500 - protein, 63 aa, Glycine max
  Glyma11g14940.1 homeodomain domain coordinates 14-76
ASSRWNPTKEQISMLENLYKQGIKTPSAEEIQQITARLRAYGHIEGKNVFYWFQNHKARQRQK

SEQ ID NO: 501 - protein, 63 aa, Populus trichocarpa
  POPTR_0010s12150.1 homeodomain domain coordinates 65-127
RSSRWNPTAEQLLALEEKYSCGVRTPTTNQIQQITSELRRFGKIEGKNVFYWFQNHKARERQK

SEQ ID NO: 502 - protein, 63 aa, Solanum lycopersicum
  Solyc06g076000.1.1 homeodomain domain coordinates 16-78
VGCRWNPTKEQIDLLESLYKQGIRTPSADQIQQITGRLRAFGHIEGKNVFYWFQNHKARQRQK

SEQ ID NO: 503 - protein, 63 aa, Eucalyptus grandis
  Eucgr.B02379.1 homeodomain domain coordinates 11-72
ATSRWNPTKEQIGILESLYRQGIRTPTADQIQQITGRLKAYGHIEGKNVFYWFQNHKARQRQK

SEQ ID NO: 504 - protein, 63 aa, Oryza sativa
  LOC_Os01g62310.1 homeodomain domain coordinates 41-103
ANARWTPTKEQIAVLEGLYRQGLRTPTAEQIQQITARLREHGHIEGKNVFYWFQNHKARQRQK

SEQ ID NO: 505 - protein, 63 aa, Setaria italica
  Si004427m homeodomain domain coordinates 40-102
ANARWNPTKEQLAALEGLYEHGLRTPSAEQIKQITARLREHGHIEGKNVFYWFQNHKARQRQK

SEQ ID NO: 506 - protein, 63 aa, Glycine max
  Glyma13g41000.1 homeodomain domain coordinates 18-80
SVSRWSPTKEQIDMLENLYKQGIRTPSTEQIQQITSRLRAYGHIEGKNVFYWFQNHKARQRQK

SEQ ID NO: 507 - protein, 63 aa, Zea mays
  GRMZM2G108933_T01 homeodomain domain coordinates 38-100
ANARWNPTKEQVAVLEGLYEHGLRTPSAEQIQQITGRLREHGAIEGKNVFYWFQNHKARQRQR

SEQ ID NO: 508 - protein, 63 aa, Glycine max
  Glyma15g04460.1 homeodomain domain coordinates 22-84
SVSRWSPTKEQIDMLENFYKQGIRTPSTEQIQQITSRLRAYGYIEGKNVFYWFQNHKARQRQK

SEQ ID NO: 509 - protein, 63 aa, Populus trichocarpa
  POPTR_0009s03460.1 homeodomain domain coordinates 16-78
GNSRWNPTKEQISMLESFYSQGIRTPSTEMIEQITSRLKAYGHIEGKNVFYWFQNHKARQRQK

SEQ ID NO: 510 - protein, 63 aa, Populus trichocarpa
  POPTR_0001s24470.1 homeodomain domain coordinates 11-73
VNSRWSPTKEQISMLESFYSQGIRTPSTEMIEQIASRLKAYGHIEGKNVFYWFQNHKARQRQK

SEQ ID NO: 511 - protein, 50 aa, Arabidopsis thaliana
  misc_feature (1)..(3): Xaa can be any naturally occurring amino acid
  misc_feature (7)..(7): Xaa can be any naturally occurring amino acid
  misc_feature (9)..(9): Xaa can be any naturally occurring amino acid
  misc_feature (12)..(12): Xaa is Lys or Arg
  misc_feature (13)..(13): Xaa is Trp or Tyr
  misc_feature (14)..(14): Xaa is Ala or Val
  misc_feature (15)..(15): Xaa is Ala or Ser
  misc_feature (17)..(17): Xaa is Ile, Leu, Met or Val
  misc_feature (19)..(19): Xaa is Ile, Leu, Met or Val
  misc_feature (21)..(21): Xaa can be any naturally occurring amino acid
  misc_feature (22)..(22): Xaa is Ser or Thr
  misc_feature (23)..(23): Xaa can be any naturally occurring amino acid
  misc_feature (24)..(24): Xaa is Asp, Glu, Lys, Gln or Arg
  misc_feature (26)..(26): Xaa is Ile, Leu, Met or Val
  misc_feature (31)..(31): Xaa is Phe or Tyr
  misc_feature (32)..(32): Xaa can be any naturally occurring amino acid
  misc_feature (33)..(33): Xaa is Ala, Ser or Thr
  misc_feature (34)..(36): Xaa can be any naturally occurring amino acid
  misc_feature (39)..(39): Xaa can be any naturally occurring amino acid
  misc_feature (41)..(41): Xaa is Phe or Tyr
  misc_feature (45)..(45): Xaa can be any naturally occurring amino acid
  misc_feature (46)..(46): Xaa is Phe, Ile, Leu, Met or Val
  misc_feature (47)..(47): Xaa can be any naturally occurring amino acid
  misc_feature (48)..(48): Xaa is Ile, Leu, Met or Val
  ERF015 clade AP2 domain consensus sequence
XXXGVRXRXWGXXXXEXRXPXXXXRXWLGSXXXXXXAAXAXDAAXXXXRG

SEQ ID NO: 512 - protein, 58 aa, Arabidopsis thaliana
  misc_feature (7)..(7): Xaa can be any naturally occurring amino acid
  misc_feature (18)..(18): Xaa is Lys or Arg
  misc_feature (20)..(20): Xaa is Ser or Gly
  misc_feature (21)..(21): Xaa is Asp or Glu
  misc_feature (22)..(22): Xaa is Lys or Arg
  misc_feature (24)..(25): Xaa can be any naturally occurring amino acid
  misc_feature (29)..(30): Xaa is Ile, Leu, Met or Val
  misc_feature (36)..(36): Xaa is Ile, Leu, Met or Val
  misc_feature (37)..(37): Xaa is Thr, Ile, Leu, Met or Val
  misc_feature (39)..(39): Xaa is Lys or Arg
  misc_feature (41)..(41): Xaa can be any naturally occurring amino acid
  misc_feature (42)..(42): Xaa is Ala, Ile, Leu, Met or Val
  misc_feature (50)..(50): Xaa is Ile, Leu, Met or Val
  misc_feature (52)..(52): Xaa is Ser or Ala
  misc_feature (55)..(55): Xaa can be any naturally occurring amino acid
  AtbHLH031 clade bHLH domain consensus sequence
RGQATDXHSLAERARREXIXXXMXXLQDXXPGCNKXXGXAXXLDEIINYXQXLQXQVE

SEQ ID NO: 513 - protein, 72 aa, Arabidopsis thaliana
  misc_feature (1)..(1): Xaa is His, Gln, Asn or Arg
  misc_feature (2)..(3): Xaa can be any naturally occurring amino acid
  misc_feature (4)..(4): Xaa can be any naturally occurring amino acid or absent
  misc_feature (5)..(8): Xaa can be any naturally occurring amino acid
  misc_feature (9)..(9): Xaa is Ile, Leu, Met or Val
  misc_feature (10)..(10): Xaa is Lys or Arg
  misc_feature (11)..(11): Xaa can be any naturally occurring amino acid
  misc_feature (12)..(12): Xaa is Ile, Leu, Met or Val
  misc_feature (13)..(13): Xaa is Ala, Ile, Leu, Met or Val
  misc_feature (14)..(15): Xaa can be any naturally occurring amino acid
  misc_feature (16)..(16): Xaa is Asp, Glu, Asn or Gln
  misc_feature (17)..(21): Xaa can be any naturally occurring amino acid
  misc_feature (22)..(22): Xaa is Ile, Leu, Met or Val
  misc_feature (23)..(23): Xaa is Ser, Ala or Thr
  misc_feature (24)..(24): Xaa can be any naturally occurring amino acid
  misc_feature (25)..(25): Xaa is Glu or Asp
  misc_feature (26)..(26): Xaa can be any naturally occurring amino acid
  misc_feature (28)..(28): Xaa can be any naturally occurring amino acid
  misc_feature (29)..(30): Xaa is Phe, Ile, Leu, Met or Val
  misc_feature (31)..(31): Xaa can be any naturally occurring amino acid
  misc_feature (33)..(33): Xaa is Ala, Thr, Ile, Leu, Met or Val
  misc_feature (35)..(35): Xaa is Glu or Asp
  misc_feature (36)..(37): Xaa is Phe, Ile, Leu, Met or Val
  misc_feature (38)..(38): Xaa is Ile, Leu, Met or Val
  misc_feature (39)..(39): Xaa can be any naturally occurring amino acid
  misc_feature (40)..(40): Xaa is Glu or Asp
  misc_feature (42)..(42): Xaa is Ala or Thr
  misc_feature (43)..(43): Xaa can be any naturally occurring amino acid
  misc_feature (45)..(45): Xaa is Ala or Ser
  misc_feature (46)..(46): Xaa can be any naturally occurring amino acid
  misc_feature (47)..(47): Xaa is Ala, Phe, Ile, Leu, Met or Val
  misc_feature (48)..(48): Xaa can be any naturally occurring amino acid
  misc_feature (49)..(49): Xaa is Ala or Thr
  misc_feature (50)..(53): Xaa can be any naturally occurring amino acid
  misc_feature (54)..(54): Xaa is Lys, Gln or Arg
  misc_feature (55)..(56): Xaa can be any naturally occurring amino acid
  misc_feature (57)..(57): Xaa is Ile, Leu, Met or Val
  misc_feature (58)..(58): Xaa can be any naturally occurring amino acid
  misc_feature (59)..(59): Xaa is Arg or absent
  misc_feature (60)..(60): Xaa is Ser or absent
  misc_feature (61)..(61): Xaa is Asp or absent
  misc_feature (62)..(62): Xaa is Thr or absent
  misc_feature (63)..(63): Xaa is Leu or absent
  misc_feature (64)..(64): Xaa is Thr or absent
  misc_feature (65)..(66): Xaa can be any naturally occurring amino acid
  misc_feature (67)..(67): Xaa is Asn or Asp
  misc_feature (68)..(68): Xaa is Phe, Ile, Leu, Met or Val
  misc_feature (69)..(70): Xaa can be any naturally occurring amino acid
  misc_feature (71)..(71): Xaa is Ala, Thr, Ile, Leu, Met or Val
  misc_feature (72)..(72): Xaa can be any naturally occurring amino acid
  NF-YC8 clade CBF/NF-Y domain consensus sequence
XXXXXXXXXXXXXXXXXXXXXXXXXXPXXXXKXCXXXXXXLXXRXXXXXXXXXXXXXXXXXXXXXXXXXXXX

SEQ ID NO: 514 - protein, 16 aa, Arabidopsis thaliana
  misc_feature (2)..(2): Xaa can be any naturally occurring amino acid
  misc_feature (3)..(4): Xaa is Asp or Glu
  misc_feature (5)..(6): Xaa is Ala, Ile, Leu, Met or Val
  misc_feature (7)..(7): Xaa can be any naturally occurring amino acid
  misc_feature (13)..(13): Xaa is Gln, Asn, Lys or Arg
  misc_feature (15)..(15): Xaa is Ile, Leu, Met or Val
  misc_feature (16)..(16): Xaa is Asp, Asn or Glu
  GATA4 clade first consensus sequence
PXXXXXXLEWLSXFXX

SEQ ID NO: 515 - protein, 69 aa, Arabidopsis thaliana
  misc_feature (2)..(2): Xaa is Lys or Arg
  misc_feature (4)..(4): Xaa can be any naturally occurring amino acid
  misc_feature (8)..(8): Xaa is Ser or Thr
  misc_feature (9)..(9): Xaa is Asp or Glu
  misc_feature (10)..(10): Xaa can be any naturally occurring amino acid
  misc_feature (16)..(16): Xaa is Ala or Thr
  misc_feature (19)..(19): Xaa is Ile, Leu, Met or Val
  misc_feature (32)..(32): Xaa is Phe or Tyr
  misc_feature (38)..(38): Xaa is Ile, Leu, Met or Val
  misc_feature (45)..(45): Xaa is Ala or Ser
  misc_feature (50)..(50): Xaa is Ile, Leu, Met or Val
  misc_feature (51)..(51): Xaa can be any naturally occurring amino acid
  misc_feature (52)..(52): Xaa is Ala or Thr
  misc_feature (53)..(53): Xaa is Lys, Gln or Arg
  misc_feature (62)..(62): Xaa is Ile, Leu, Met or Val
  misc_feature (68)..(68): Xaa is Asn or Lys
  GATA4 clade GATA-ZF domain consensus sequence
RXCXHCAXXXTPQWRXGPXGPKTLCNACGVRXKSGRLXPEYRPAXSPTFXXXXHSNSHRKVXELRRQXE

SEQ ID NO: 516 - protein, 65 aa, Arabidopsis thaliana
  misc_feature (1)..(1): Xaa is Ser or Thr
  misc_feature (2)..(2): Xaa is Cys, Gly or Ser
  misc_feature (3)..(3): Xaa can be any naturally occurring amino acid
  misc_feature (6)..(6): Xaa can be any naturally occurring amino acid
  misc_feature (9)..(9): Xaa can be any naturally occurring amino acid
  misc_feature (10)..(10): Xaa Asp or Glu
  misc_feature (13)..(13): Xaa is Lys or Arg
  misc_feature (14)..(14): Xaa is Ile, Leu, Met or Val
  misc_feature (16)..(16): Xaa is Arg or Lys
  misc_feature (17)..(17): Xaa is Asp or Glu
  misc_feature (21)..(22): Xaa can be any naturally occurring amino acid
  misc_feature (23)..(23): Xaa is Ala or Glu
  misc_feature (24)..(24): Xaa is Ile, Leu, Met or Val
  misc_feature (28)..(28): Xaa can be any naturally occurring amino acid
  misc_feature (29)..(29): Xaa is Ser, Ala or Gly
  misc_feature (30)..(30): Xaa can be any naturally occurring amino acid
  misc_feature (31)..(31): Xaa is Gln or Glu
  misc_feature (34)..(34): Xaa is Gln, Arg or Lys
  misc_feature (36)..(36): Xaa is Ala, Ser or Thr
  misc_feature (38)..(38): Xaa can be any naturally occurring amino acid
  misc_feature (41)..(41): Xaa is Gln or Lys
  misc_feature (42)..(42): Xaa can be any naturally occurring amino acid
  misc_feature (44)..(44): Xaa is Arg or Lys
  misc_feature (57)..(57): Xaa can be any naturally occurring amino acid
  misc_feature (63)..(63): Xaa can be any naturally occurring amino acid
  misc_feature (65)..(65): Xaa is Lys or Arg
  WUS clade homeodomain consensus sequence
XXXRWXPTXXQIXXLXXLYYXXXXRSPXXXXIQXIXAXLRXXGXIEGKNVFYWFQNXKARERXKX

SEQ ID NO: 517 - protein, 61 aa, Arabidopsis thaliana
  misc_feature (10)..(10): Xaa is His or Gln
  misc_feature (20)..(20): Xaa can be any naturally occurring amino acid
  misc_feature (23)..(23): Xaa can be any naturally occurring amino acid
  misc_feature (25)..(25): Xaa is Ala or Thr
  misc_feature (34)..(34): Xaa can be any naturally occurring amino acid
  misc_feature (37)..(37): Xaa is Asp or Glu
  misc_feature (40)..(40): Xaa is Ile, Leu, Met or Val
  misc_feature (45)..(45): Xaa is Gln or Glu
  misc_feature (47)..(47): Xaa is Phe or Tyr
  misc_feature (49)..(49): Xaa can be any naturally occurring amino acid
  misc_feature (52)..(53): Xaa can be any naturally occurring amino acid
  misc_feature (55)..(55): Xaa can be any naturally occurring amino acid
  misc_feature (60)..(60): Xaa is Asp or Glu
  misc_feature (61)..(61): Xaa can be any naturally occurring amino acid
  ERF054 clade AP2 domain consensus sequence
KLYRGVRQRXWGKWVAEIRXPRXRXRLWLGTFDXAEXAAXAYDRXAXKXRGXXAXLNFPXX

SEQ ID NO: 518 - protein, 51 aa, Arabidopsis thaliana
  misc_feature (3)..(3): Xaa is Ile, Leu, Met or Val
  misc_feature (4)..(4): Xaa can be any naturally occurring amino acid
  misc_feature (5)..(5): Xaa is Ala or Thr
  misc_feature (8)..(8): Xaa can be any naturally occurring amino acid
  misc_feature (11)..(11): Xaa can be any naturally occurring amino acid
  misc_feature (12)..(12): Xaa is Arg or Lys
  misc_feature (13)..(13): Xaa is Ile, Leu, Met or Val
  misc_feature (14)..(14): Xaa is Asn or Lys
  misc_feature (15)..(16): Xaa can be any naturally occurring amino acid
  misc_feature (18)..(18): Xaa is Phe or Tyr
  misc_feature (19)..(19): Xaa can be any naturally occurring amino acid
  misc_feature (22)..(22): Xaa is Ala or Ser
  misc_feature (26)..(26): Xaa can be any naturally occurring amino acid
  misc_feature (28)..(28): Xaa is Ser or Thr
  misc_feature (30)..(30): Xaa is Ile, Leu, Met or Val
  misc_feature (32)..(32): Xaa is Lys or Arg
  misc_feature (34)..(34): Xaa is Ala, Ser or Thr
  misc_feature (37)..(37): Xaa can be any naturally occurring amino acid
  misc_feature (40)..(40): Xaa is Ala, Ile, Leu, Met or Val
  misc_feature (41)..(41): Xaa is Asp, Asn or Glu
  misc_feature (42)..(42): Xaa is Phe or Tyr
  misc_feature (43)..(43): Xaa is Ile, Leu, Met or Val
  misc_feature (44)..(45): Xaa can be any naturally occurring amino acid
  misc_feature (47)..(47): Xaa can be any naturally occurring amino acid
  misc_feature (48)..(48): Xaa is Gln, Asn or Lys
  misc_feature (49)..(49): Xaa is Gln or Glu
  misc_feature (50)..(50): Xaa can be any naturally occurring amino acid
  misc_feature (51)..(51): Xaa is Asp or Lys
  AMS clade bHLH domain consensus sequence
KNXXXERXRRXXXXXXLXXLRXLVPXIXKXDXAXILXDAXXXXXXLXXXXX

SEQ ID NO: 519 - protein, 63 aa, Arabidopsis thaliana
  misc_feature (1)..(2): Xaa can be any naturally occurring amino acid
  misc_feature (3)..(3): Xaa is Ser, Ala, Thr or Cys
  misc_feature (6)..(6): Xaa can be any naturally occurring amino acid
  misc_feature (8)..(8): Xaa is Ser or Thr
  misc_feature (9)..(10): Xaa can be any naturally occurring amino acid
  misc_feature (12)..(12): Xaa is Ile, Leu, Met or Val
  misc_feature (13)..(13): Xaa can be any naturally occurring amino acid
  misc_feature (14)..(14): Xaa is Ala, Thr, Ile, Leu, Met or Val
  misc_feature (17)..(18): Xaa can be any naturally occurring amino acid
  misc_feature (20)..(21): Xaa can be any naturally occurring amino acid
  misc_feature (23)..(23): Xaa is Thr, Ile, Leu, Met or Val
  misc_feature (24)..(24): Xaa is Lys or Arg
  misc_feature (27)..(27): Xaa can be any naturally occurring amino acid
  misc_feature (28)..(28): Xaa is Ala or Thr
  misc_feature (29)..(29): Xaa is Asp, Asn or Glu
  misc_feature (30)..(30): Xaa can be any naturally occurring amino acid
  misc_feature (32)..(32): Xaa is Gln, Glu or Lys
  misc_feature (33)..(33): Xaa can be any naturally occurring amino acid
  misc_feature (35)..(35): Xaa is Ala or Thr
  misc_feature (36)..(36): Xaa is Ser, Ala or Gly
  misc_feature (37)..(37): Xaa is Gln, Arg or Glu
  misc_feature (39)..(39): Xaa is Arg or Lys
  misc_feature (40)..(41): Xaa can be any naturally occurring amino acid
  misc_feature (43)..(43): Xaa can be any naturally occurring amino acid
  misc_feature (60)..(60): Xaa is Gln or Glu
  misc_feature (63)..(63): Xaa is Lys or Arg
  WOX1 clade homeodomain consensus sequence
XXXRWXPXXXQXXXLEXXYXXGXXTPXXXXIXXIXXXLXXXGXIEGKNVFYWFQNHKARXRQX

SEQ ID NO: 520 - DNA, 1009 bp, Solanum lycopersicum
  RBCS3 (Ribulose 1,5-bisphosphate carboxylase, small subunit 3) leaf-specific promoter
aaatggagtaatatggataatcaacgcaactatatagagaaaaaataatagcgctaccatatacgaaaaatagtaaaaaattataataatgattcagaataaattattaataactaaaaagcgtaaagaaataaattagagaataagtgatacaaaattggatgttaatggatacttcttataattgcttaaaaggaatacaagatgggaaataatgtgttattattattgatgtataaagaatttgtacaatttttgtatcaataaagttccaaaaataatctttaaaaaataaaagtacccttttatgaactttttatcaaataaatgaaatccaatattagcaaaacattgatattattactaaatatttgttaaattaaaaaatatgtcattttattttttaacagatattttttaaagtaaatgttataaattacgaaaaagggattaatgagtatcaaaacagcctaaatgggaggagacaataacagaaatttgctgtagtaaggtggcttaagtcatcatttaatttgatattataaaaattctaattagtttatagtctttcttttcctcttttgtttgtcttgtatgctaaaaaaggtatattatatctataaattatgtagcataatgaccacatctggcatcatctttacacaattcacctaaatatctcaagcgaagttttgccaaaactgaagaaaagatttgaacaacctatcaagtaacaaaaatcccaaacaatatagtcatctatattaaatcttttcaattgaagaaattgtcaaagacacatacctctatgagttttttcatcaatttttttttcttttttaaactgtatttttaaaaaaatattgaataaaacatgtcctattcattagtttgggaactttaagataaggagtgtgtaatttcagaggctattaattttgaaatgtcaagagccacataatccaatggttatggttgctcttagatgaggttattgctttaggtgaaa

SEQ ID NO: 521 - DNA, 1714 bp, Arabidopsis thaliana
  RBCS4 leaf-specific promoter sequence
caaatttattatgtgttttttttccgtggtcgagattgtgtattattctttagttattacaagacttttagctaaaatttgaaagaatttactttaagaaaatcttaacatctgagataatttcagcaatagattatatttttcattactctagcagtatttttgcagatcaatcgcaacatatatggttgttagaaaaaatgcactatatatatatatattattttttcaattaaaagtgcatgatatataatatatatatatatatatatgtgtgtgtgtatatggtcaaagaaattcttatacaaatatacacgaacacatatatttgacaaaatcaaagtattacactaaacaatgagttggtgcatggccaaaacaaatatgtagattaaaaattccagcctccaaaaaaaaatccaagtgttgtaaagcattatatatatatagtagatcccaaatttttgtacaattccacactgatcgaatttttaaagttgaatatctgacgtaggatttttttaatgtcttacctgaccatttactaataacattcatacgttttcatttgaaatatcctctataattatattgaatttggcacataataagaaacctaattggtgatttattttactagtaaatttctggtgatgggctttctactagaaagctctcggaaaatcttggaccaaatccatattccatgacttcgattgttaaccctattagttttcacaaacatactatcaatatcattgcaacggaaaaggtacaagtaaaacattcaatccgatagggaagtgatgtaggaggttgggaagacaggcccagaaagagatttatctgacttgttttgtgtatagttttcaatgttcataaaggaagatggagacttgagaagttttttttggactttgtttagctttgttgggcgtttttttttttgatcaataactttgttgggcttatgatttgtaatattttcgtggactctttagtttatttagacgtgctaactttgttgggcttatgacttgttgtaacatattgtaacagatgacttgatgtgcgactaatctttacacattaaacatagttctgttttttgaaagttcttattttcatttttatttgaatgttatatatttttctatatttataattctagtaaaaggcaaattttgcttttaaatgaaaaaaatatatattccacagtttcacctaatcttatgcatttagcagtacaaattcaaaaatttcccatttttattcatgaatcataccattatatattaactaaatccaaggtaaaaaaaaggtatgaaagctctatagtaagtaaaatataaattccccataaggaaagggccaagtccaccaggcaagtaaaatgagcaagcaccactccaccatcacacaatttcactcatagataacgataagattcatggaattatcttccacgtggcattattccagcggttcaagccgataagggtctcaacacctctccttaggcctttgtggccgttaccaagtaaaattaacctcacacatatccacactcaaaatccaacggtgtagatcctagtccacttgaatctcatgtatcctagaccctccgatcactccaaagcttgttctcattgttgttatcattatatatagatgaccaaagcactagaccaaacctcagtcacacaaagagtaa

SEQ ID NO: 522 - DNA, 1923 bp, Arabidopsis thaliana
  At4g01060 (G682) promoter sequence
ttattaagtgctatgcgttaatcggcatctataaagtgttgcattgatgaacaaagtggatgcctaaactagacgtttaactaaatgtttagaatgaaatcttcatctcatctaaaaagtgttgcattgatgtaaaaagtggatgcccattagttcttggctttgaaatgtttttagaatgaaatcttcatcaatctccatatgtggttcaatccactcattttatcttttgttaaagatgttcttcaggccaatataatgatgaccatggatggtttgcaactcgcatataacacttctttatccgatggttacaagtattacatggctatagatagcttttgcatgcaacaaattatctatcaaagtttatgcatcctctaaaatatggtcattggcaagccactaaacgtatatattgtgacaatgtatgatgatatatttttatgtgttgactccgtttttcattaagtaatgaaacatgttgctctagattaccattttaatcgcaaacatatatgttgctctaccacgcattgcatcaaatgataagcttgaggacgcttcgacaaaaacatatttctccttcttcttactgaaccaaatgacaattgacaaaccccattaataaaatcggttagtgttaatgtgtcactcataatattaacttagtaaagaacaagaccacattaattaaatcaggtgttagtctgagaatatacgtttctcttcctcattccaaacttaaattcggaatttactgagaatatattgttagcactgaaaaaggttaagttgaaagtttgctagggatggcaattaaatatagtcttgccttggggatattcccttcgtggacttgtaagtttatttataggtcctcttatgtatatatagatgatctaacgatcgatatactatgaaaaaagttgttactagattttattgcaggtaatagtgttgaataacccgaaccaataaagcagttgtaacgaacacacgacacgttgcttactgcgaggaccactttgttttttgttttttttggctttaagccaatttaggaccaaatttgcatgattgaggatgcaagtatccaacccattttcatctttcgtagtgacactcatttacttttgtgatggacacgttatagtatatcttaaatattaaagagacatgattgggggatcattgttttaatttaaataatgtagattctattcttttcatggtattaatccaatttatagaaagttatgtgttattagcaattaagctaaatgatgaaaacaatcagtttagtgaaacaaactcgccgagaaaacatgaatggttgaaaatattattgtgttttacaaacgtacacgaggacaatagttttgtaagtttttcttaggcattgaaaaatgtttgatacaaaaagtaatgttaaaataattaaaaatgattttgtcttaatatatccaaaatttcaatctattatgaacaaagggagtataatttctgattgaatgaactggaatagcaatcagaaaagctttgaaaacaattgttgttgattattaatgatcttaattaacggcatgtatcaatatttatacaacttatgttccagtccaagccatcacaacggagtaaatgaagtcacgggtacttgtggtttttattggttgcaaacttgcaacttgcaaagatagctaacaataattaatataattaatgagaacaaaaccaatttagtaaattaaaatcctttaacatagaaaccgaccaaacccgttggaccgttggttacttgatttggttagttgctataaatagaaatgatggttcgtgtgcaaccttcaaaatacgaccactctctcagagtactctcttagtttctttcttcttcttctttgtaatacggtgccgtttgac

SEQ ID NO: 523 - DNA, 1500 bp, Oryza sativa
  Os02g09720 location: Chr2:4997678-4999177
ggccgtcgtcggcgagttctcagctatagcttggtagctatctagctcaatttgctgtctccaagtgtgacagctagttgtaattgagttggtatagctttggcctcttcttttatttttttcaggccgtttagatggtaacctctctgacttgagagagttagagaggccttgtatatacggagtatatagtactccagtttagttgccatgccagcagttgcatgcactagtaagcaactagtctctcggtttcatattacaactcgttttaactaagtttatagaaaaaacatagtcgtatttttaatacaaaacaaatatattatcaaaatatatttaatgtttggtttaattaattaacattggtgtttttgatgttactaattttttttataaacttagttgaacttaaaataaattggttaagaaaaagttaaagcgacttgtaatatagaacggaggaggtagctattggtcaaggggatgtgcatccatgtttggtaggtagccgtggtggctttggtgtgtcattctctatcttttccacacacacactttaaatttgctggctttttagaagaacaatggtaatgtttcgcttttattttgctcatggtaaaaagattgtgtttcgcttttcgaggggcaaaaattaagtctaattgatgctattgattaataagatcgtgatcgcgaggaggattgagatgtctcgatggacataatagaatcttaggttcaaggaatttacactctttaataaagacttcgcttgcaaagatgtaggccaaatgaaagagacttaagcatgcttgttgatataatactagtttattttgagaattaggatttaatttgatgcactaaacctagagtaaaaaccataagatgacctaaatctgtgccaatatatttctagttggttcataattaatcaacggaatgagtatgcagtttttctcttaaaatgcctataggagttaggtgccatgctacaccacactactgaaactgaattggtgccggttggaaaccggctatagatgtcggatatcctaactgatacccagtagacgacacctttggcttcagtcatcgatcccgccggcatcttttacttacaaaggtgtcggttttgaatacagaaccaacacctatactgtcatataggtgtcagttcttaaattgattggcgtatggacagttttacatgtgacttttacaggtgacagttcgtaaatacaactggcacctataagaagcatatatgtgccatttgtacaccgggcaggacacgggacaagggttataggtgtttgtttgtaagtaaaaccagcacctatatgttagcaagaaaaaaaataaaaatgataggacctaccaatttcacatacatatcacacaataacagaaattcacatcacttcaaacatacaaccacattcacattcaaccaaactatatatattcaattccacatccacaaccctcatccca

SEQ ID NO: 524 - DNA, 1500 bp, Oryza sativa
  Os05g34510 location: Chr5:20455817-20457316 (reverse complement)
ctatatcttcctacctatccccctgcaagctaacaaggggaattacttgcacatctaatgatggactggtgttgttatgcggttgtgttggggtgagatggaggatgtctctcctcccccttgctagcctttaaaaaggagtcctacaggggcataacaggaatgagaggaagcttctggagatcaattctcacaacacacatttcctacagtacagttttgcccccagacagatcggatggtgtgtgtcagcagcctctatgcctgtaggcatgcattcagttgaatggttttgtctcgatcgacggcgaaaaaggatttacttttggacaagaaaaaagagcctttaatccatgagattactacatctcgcatacagggacaagtattacagctgtgagtgatgcttaagagactttacggttttgtttgcagctaagcaggaattaatataaataatctcccttttcagggctctgcttgcatgaatagctaccagccagagccaagagtgccagagacatcaagcctggatggtagtagtacagtacttgcgttactcgtgcccggcgttgctgcttcggtggggcccacttgaactggccgtcctcccgagccgtcggtgggggtggtccccaccaccggccagttactttgctcccgtcgattcggcccggtgcaccaacagcccatttttttatgatgggcttgcaacttggcccaacttgttggattgtcaaggccggagggaggcccatctgggcgaacttgtgtgggccgcttctttccattttagagaggaaacatgggctgggctacgggctgcgggctgccacctatcaccggagaaacacttgctcgcagcctcaaatacttgaaaccaggctttgaaaattcggcaaaaatcatcaaacctccgaaagtatgagagaggaaaatcaattatgatcttcctaattgtgtcatgattagcatagcgcatcaaagcaccttatcggtgcaaaattaatccctttcaaaaccattgtacttcatgaatcttgctacatatcttaaaaacgttgacgggcttacagcttaccagagatcaaagcgagaggcagaacaaagttcaaaatctgccgtgtataacaacaacaagtaattacagtagaaacaccttactactcatcaatcactactactaacaccaccacatacgaatcatttctaccagatccaaacaaagaaaaaaaaagagggagagagaactaattaaaaacacgaaatccgaaccggttcaactaatcaatcttcgccacaatctccagctccagcgatgaactgatgatcatggcggccaccaggtcaggtgtatgtattcacaggtttcgccgcgatttgacatgattggaagtggaacgcaaactcacgcggccactccggcgccggcgccgatgcaggagaagacgcggacgctgcgggccttggggagcgctacccgcggcagccgccggccag

SEQ ID NO: 525 - DNA, 1500 bp, Oryza sativa
  Os11g08230 location: Chr11:4325545-4327044
cgccgtatccaccttcaccagctcgatctccgtcgttgatcgttgattgattacgtactacctgagtgatgatggacgtggatcactggaatgggttgagaaaataaaaatgatttatgtagtgtgtaggagtactcaactaacaattgaacgaccagaatttgacgaattttatttacatgtttagagaccctgggtagagattcagtaataattaagttcttgccatatttttgcatcaatttaattattttactaaaatgatttatgttgttttattttcttggcactatatttgcatcaaatataattaaacttagcttaactggccagagcttatatatggctcagatttaattcccctcttatcttcagagcattaaaaagggagtatcctaaaatacctatctcctaaaagatcaatctgcctgtggctcaaatctatataaagtgagctcccctcccactgtcccacatatctatatagctaccatggcactacagcttgcaacacgctcaaggaagtctctcgccatcgccgtcgccgccgccgtgccgctgctgatgtgcctcttcctcgtcgccgccgccgccgcggctgcatcgtcggagacggcggtggcgagctccccacagtaccagccgagctatggtaatacgtactcgacgtgcttcgaggtttcggcatgcgatgacaccgggtgcgcgatcaggtgccgcgacatgggtcacaaccctgctggctcagcctgctggaccagcaacgtcgcgaccatcttctgctgctgcggccgtggtcgtcctcctccggttgcttgatccatatgtatacataattacatatatggtatatgtataactggataataaagcgtatgtgcgtgtcagcgtgagttggtgaagatgacttataacatgaaacaggagtagcgctagtaatgagatgtgtgtaaaaatgttatggttcaattaattaatcaaagtcgatctttgcattgcatgctgatacatatctatcgaaatatatatgtactaagaccaagaatcaaagtcgtactactcgtatatgtacaaaataattaattttaggcaaattttgctacaggacaccgtaattgtgtggttttagcctagggacaccgcaaaaacaaagtttgaggaaagacactacgtaaccgtggatatttgcgatggacaccgcaccgtctaaacgaaacttgctatgctgacgtggcggtcgggagccccttttttgacgcggtcggaccgaaatgcccctgcaccttacctcctcatattgcttgctggacactaaattgtttgctggacactaaatacatagatagatacatcgtacatatacatgacagatataccgacatggactacgttccttctagccaccgctgccggcgagctccaccgccgtcatatggttgttgcgcctggcgtgagaggtatatgcggcattgcatcactgtccggccaactttgaattaa

SEQ ID NO: 526 - DNA, 1500 bp, Oryza sativa
  Os01g64390 location: Chr1:37374848-37376347 (reverse complement)
tgtccagggctccaggccgtgatcagcgctcgctgctacgctcagaccaacacaggaaattattacttgctccctactactacgtgcaagcagcgtaaagggggcaggccactgtttgaaattcatccctctcaccttttgaaacagccgcgcgtcgtgccgctgtagtagtgcagctgtgcaggtgcagtagctttgggtcaaaactcaaaactcgaaagggagacagcaccaaaaagatactgcggctgcagccacacagggctagctgcttgacgcagagagttcgtagcgacgttgctcgtctgggcatggcagtcgcgcctagatcggctcgtgcacggcatgcgttgcttgcctgggtacgccaccacctgcgcagccagcgatcatggccggcgcggcgtcccacggcacgagagcgagcgcgcgcgcgcgcggcactctcgtgaaggcgtacgcgccatccggccgcgcggcgcggcgcaggccggtgcagcgtgcaggttgacccgcgacaggcgcacggccgcacacgcggtgcggcgggccggcggcctggatttgggcggagttctcggtggccgtcgcttttcccgtgccagctgacgcgattacgagccgtacccgatcaaaaccggcgtgatcgccggtccgatgcatgcgttttgttttcatgccagatctttggtaatcgttagtacgactctctgagtccgcgagtacgctggtttctgttaattgcagcctacagtattttctttttcttttttgcctcggggaagcgatgcgagcgatacgtgataatttcaggtggcgcagtgccgctgtgcatgtgtgaaatcatgcaagattggcaggttgctagcgcgcacgtactcctctctggtgtgatcggtttcaggtgatagagacgatacatgggcataccttgacacggagtgggctgggatggcgcgggtggtccatcggctacagccttacatgctcctcctatcaaactctcgttatgtccagttcacttggcccatccttggtttcctctacgactagtgctcctctagccagtagccactacccactgtttccatattggcgcacgggtcatataagatggtttgttcctgttcacctgacgggaaattctttctcctaaaacgatatcgaaccatccttatccggattggattaacgagatcgtcgtgctaagtgtgctaacacacttgttatatgaccgttattccgagttcgtcttgctgctgggagagttgcagaattgtagtactcccttcgtttcatgtgacaagacgttttgactttagtcaaaattaaattgctttaaatttgattaagttcgtaaaaaaaagtactacctccgttttacaatgtaagtcattttagcattaacgagcatggtggctcgcgcaaattgcgcggctagcatcattatattttctctcatataatagcatatatgttttctcattatattattcaaat

SEQ ID NO: 527 - DNA, 1500 bp, Oryza sativa
  Os06g15760 location: Chr6:8954266-8955765 (reverse complement)
ctccggcgaggcggtggactcggactccgactccgacgaagtcgaagagatgatcgaaaggtttgggagtcgcggcggcgaggatgaggggggtggatttggtatatttacgggcgcgggtttgggctttttttcgcgaatgggccccgcccggtttgacttctgcgatagggatgcccctcaaaaggtagaaaaatactcaaagaaatactcctaactccgtttctaaatataagtgatatatatatactactcaatcccttttagattggaagatgttttaactttgaccaaagtcaaactactctaaatttaactaactttgtagaaaaaattagtaatatttataacactagcatagtttcattaaatctataattgaataaattttcataatatatttgtcttgggttaaaaatattactattttttttacaaaattagtcaaacttagattagtttaaatttgaccaaaatcaaaacgtcttgtaacctgaaacggagggagtatttcttttagctggagaataggtgaaactatccctcttcaaaattttaaccagtcggatttttataaaaaaaaatattttcaaatattttagacaagcatattaccaaattatattgcatcttaaatatataaaagtattgcgaagtggtgctatactttttggcgcaaaaaaaaactcaaatacttcacatccctttttatataagggaaactttcttttactgaaataaataataagtgaaactatttatctttagattttagccactcgtattttttagactgatgccacttatttttctaaacaaggttttcaaatattcaaaacaatattattctcaaattataaaagcttgaacctttgtttatcgtaatacaaccatgtaagaaatttttagtggtgaaaacgaaaaattgtccagccaaatacatgtcatcttcacatcttctactagtttgatccacctttggtgtttaatgttttcacaaaaggagtaagatactacgtcgcacaattttggaatcagttgttggaaataatttattctattttggatggcataatactttcagactttcattatagaatttactatatgatcattttttttatatttcagctggctatcatttgaagggatgggtgaatttatcccatgacattaatcccccccctccccctaaatttttataacttatcggctgtgtcttttatataccacagatatgaatcagttttcatcattattaaaaaaaatcaagacaattattttaaaacaatatttagcgcggagattcgtgctgggtcgtccacgtatgcagcatgggtgtcgctgtggggggtttggtgattgctggtcgttgtcgtttcgtggccggttgcagtttgtagccaagggtggtggcatctgatatctggccacacactttggttatggaatgctgggtttgctgctggtgtggtgatcaaccggtgggtgattggtttg

SEQ ID NO: 528 - DNA, 1500 bp, Oryza sativa
  Os12g37560 location: Chr12:23047433-23048932 (reverse complement)
tgacggcgtctccttcttcttgcttcttgcttcttcttcttcctcctcccgatctggggttgtaggaagctactggtcgtgatcaatggagcattccgccatggatggattggatgggatggggagaaggggagggggagaagcgcgcgttgctggcgatgttctctccgcgtggggggtgggatgcgatgcgatgcgatgcggaggaggaggaagacgacgaggactcggctagtctggagttaattgattaattaattgattaattaggagcaggagaagtgcaagcacgacgagagtgaagggaaaggaaccgccgtttcaaaaaagatggaatttttgcggccaaccccttctactagtgacgaatcacggtcatgtttgccacaactttcaggctgagttcgtttctttgatactccattcgtaccgtaaaaaaccagcctaatactagatgtgacacatcatagtattacgaatctggagatacctctgtccagatttattgtactcgaatatgtcacattcagtcatatattcgttttttttggacgggggagtatctaattcactcctcggctaatgattaattaatcatgtactaatggatcactctgttttccatgaacacagcctcgggttaggtcttagatccacgacagatttaaatttttaagttttatttaaaatatgtgtaaaatgatttatccaaatgttatagacataattgaggatctaaatacatggatttgtggagcttgaaatattcagcttctaaaaatcttgaatttggagctatgctaaagaggacctacgtatcctgcagttaacttattccaaaaagaaaaacaatatccaaacctgatgcttaaaaaaacacactgaaaattaaaggcgttatataaaaagtatatataaagtattaaacttgacaaaatgtgttggagaaaccatgcgtaaaactccagatattacctggagacaaaagggcatgtagtcaatgattgcaaaacaaattctctggaagtaacggaaataattgaaagttatacatatccaagtaggatttactacttacatagccagccattatccactgataattgctgctattatcaccataatcaaccgaataatcagccaagaggttatcccaacgataaatgactttgatctctcctttggtttaactcaaatgaatgataatggcttatcaaatgaccagtcatcttgactacaaaatcatatgataattaacctcattaatttatcactagtggctgataaaatgggatatagagaatgctttggaattcatgatatttgctaatttataggtaaatttctaacaaacatatggtaaaataaacccccataataatcgtactaccaaactataccaaacaagtactcttagcatgtatatatagccacaccgatcaactagaagactcaaaataccaataggttgtcggcatcgcctaaccgtgatcagacatc

SEQ ID NO: 529 - DNA, 1500 bp, Oryza sativa
  Os03g17420 location: Chr3:9689781-9691280 (reverse complement)
gtgttcgcacgacgatagggctctgacttcttatggaagatgaacatgataaacgtagatgccttttcatatagtacgacctacctgaagacatgagatgagatttattagacgttttgctggtcaacacacaacacgtcgatgactcgtgcgacgcaaatgcaaatccagatgagttagtggaccctcacacttatacataggagtaggtgtcatctgagtcaatatactagcaagagtgagtttgaaagagatgttgggattgagcttttttttagcacatataaaacgagataagtcattactatatgattaattaaatattagctattgcaatttgacttctatgtaaaaattttttttcaaaaacatatacattagtttgcaaagcgatgaaatagtttacccaacttctctttagaactcagcctaaataaatctaacccctaaatatgctaaatgtgccagccctagtccaaaatttaatgagacctaccataagaatgttgacatgacatcttcaccaatcctacaaacccttaaaaagttaaaagtttgaagaaagttggaagtttagaaaaaaagttagaagtttatgtgtgtagaaaagtttttgatgtgatatgatgtgatggaaagttgggaatatgggggaaactaaatacggcctaacaagtatggcacacacacgctttatttttaccttttttcttctttttattctgtctttcattctccttttctatttctttgcttctatgttcttcctcaagcgagccttccttgagctcaagttgttgccattgagctcatggtgggctggtgggcatagtcgtgcactcacactaagcaactatcgttaagctttccatggctgctgtaacatcccggcccagggcttaataggattaatataagacttgtgcacacgagtgaggacaaagtgtgcagaaaagacttgtgttggtctgtgagggcagtctatgacctatgaaagctgccagatgtaagcggaccacttcttttctggaagccgatgtccaaagaactttagggttaagcgtgcttggcctggagcaatttgggatgggtgaccgaccggaaaattcttcccaggtgcacacgagtgaggacaaagtgtgcatgaaagctgccagatgtaagcgggcccagcttgggagaggcgggacgttacagctgcgatgcttaagcgtccctatcggccgccaccatcgagctcgtcctacccttggtcaccaccactcctctaccatcactgagctcctatgcatccacggccaaaacaaaaaccctatccttacgtatctcctctttcaccaaccgaaacccaccctagcctccattgcttcagtcaccgccattaaacaatattagatcgaaatcctaattcttcgccagcacaaaatgactaaattcattagtgttgcttctcatgttccaaaattaaacatgtatacgagttcattgtacccggtaatc

SEQ ID NO: 530 - DNA, 1500 bp, Oryza sativa
  Os04g51000 location: Chr4:30185779-30187278
gcgaggatggctactagcttgctgtccttgcggtcggccgggctcggtttctccggttgtttcttgtgtttcgcccacacacctctgtgcgtcgcgttgggctcgttatatagcggccactgtagtgttgggctatagttgctgcacgcggttgacttgacaaatctccatagctcgttgcattggtccggatcgatgtatctgcattcacgctagcttttggtttttgtccaatacttggaggaagggagcgagctaccgatcgatactacgtgaaaacgacctgtcctgtagaaagctgcatgcgtcgctagagcacacacgatttgatagtctagattctagtaagccctattacgtgccggtacataaaaagtaggcacagtaagccttataggagtaatacacccacacattgtgttgtcctgtcacggcgtacgtgcatttgtaatgtggcgcacgtctcaagtgtccttcgatcttttcgtcccgtctctccttggaggtagcaacggcgtcactgttcctcttccgaagaaaaaagatactcctgcatgcgtactgttgttgcgtacacggtgaacacgggtgaggccgtagccttgtgcccttaattatcgtacgtggcggttgtccatgtaatcgtgtgagcggtgggggcagaagattagcgtgtcattctgcagattttccccacgctagggcaactcaaaaatgtttttgattccgagggcgaaaatatactttttaagaattattttaccattctggataattaatgtatcgagagacaccgtatttttttaatataaaacttaatacttttagatactgtgtattttgagataaacaaaagagtaaattgcatcagcggtacacgaacttgtcaggttggtgcaatctagtacatgaacttctaaaacgctcgtttctgtgcacgagcttgtttgatgcgtgcgaataatgtcaaaatcgcactgcaaggttaatcttgttgattctgtggttgatttaaactctatgtaaacattagtctaagaaggataaacatataataaggcataatgattgtataaaaaaataaaaatttgagtaatgatgcaagggacagaaacaaagaaagataaagtggaatctaagaaaaatcggtcttgtcgcaccattttagtcttagtttgcacataccagacaaattcatgcaccaaaacgagacgagcattttataagttcatacactaaattgcacgcacctgacaaatttatgtaccgctaatataatttactctaaaaaatgtagtgtaaaatttctcttcttttaaagtctcactatggtgcattcattggtcttatttgattggaggatttagatcttttttacaattatttcaattaacggtagtagaaatatggagtgatatttattgtaaaaaagaataatgtgcatggtgtataattgtcatttagcaatgattaaatatttgtttctctttctggattttt

SEQ ID NO: 531 - DNA, 1500 bp, Oryza sativa
  Os01g01960 location: Chr1:522445-523944
gacctcgaggaactcctcgtatttctccctcttgtcctggaacttatccttgacggccttgaggtagacgagcgcatcgttcgtggtgagcttctggccggccgttgcgccgccggcgggcggctgagcaggcggagcagcggcggcctgaggcggcggcgctgcagcggaggcaggccccagaggcatgtgctgcggctgcgccgtcctacaccacgagaggaggggcaaacagttagatcaaaacgcaaaacaaaatcgcaccctaaaaaacacctcctttttttttgcgacgtagagttagaaattggaacacaaaatttgacggtgaagaagagagattccccaaaggaaacccgaattcctcccgcagatggaaataatatatataattaattattcactccctcgcgggctgagggtgagggaaacgaaaccgaagtgaagtttattttgaaaaataaaacaaacgaaataggcaggaacgcctggaagggcgaaggcgatgagcaccgaggaagccaaggatggaggaggcgaggagaaaagcactcacggatcggatcgaccgacgttggggcgcttgagttgggagcccatgagcgcgtcgtccctggcgcgcttcatccccccatacacagactcccttcctcctcctccccctcctcccttcacccaaccaaaccaccgccgcctcctacagaacaacctcccggtcgccgccgccgccgccgccgccgatcctctcaaacctcggaagacgtacaccggcgccggatctgcccgccgctggctcctgcgagaccccccgagcgcggcgcgaagagggcgcagcgcgaggcgaaggcgacgcgcggggaggagaggcggctaatcgcctcggcgagacgcgagacgcgagagggaaggatgggtgaggaacgaggcaagggcgaggcgaagaagaagaagagaagcgaggcctcctcttctctttaacacaacgaagagaagagagcgcatcacaacccatgtacacccaccggtgccaccacgctgccccgcgcccgtcgcgaaccacatcccgcccgcacatccccagataagggacacgtggacgtaccggatcgaccgccctagggtgcgaaatggttactggcggtgatcgcaccggtgggagggttagcttgtttcgtgggtaaacacaacctacccattggatttggggattccagtgagcggtctggattagcgcggggttacttcgagattagtgcccccgggcccacctgtcagtcggatgagtgcctccgatctcaggtttaacctagctccgctagggcggcgtcggttcgtatatccgcctcatgcgtgtgtgtcttctggctcaggagacgtatttccgtgggatccgtatatacatgggcttcatttggccatttgtcacgatccctagcttccagagagggctaccgctggatcttcagtttcatctgcagtatcaaactattaataaaaaag

SEQ ID NO: 532 - DNA, 1500 bp, Oryza sativa
  Os05g04990 location: Chr5:2418356-2419855
tgataacgatggtgcgccttcgtgatcgatcgagagcgtgaggagcaacgcggttcaatttatagacgatgcagatcaagctggtgccaagaagtggcgggaggttgatgacgatcgatcgatccgaggaagaagaagaagaagaaatgtaagtggtgatggtggtgatcgatcgagttgagttgagaggcggcatgcgcgcatgcatgaggatgagggggaggcaatggtaatgattgtgagcattatggggaggggagaggaggatcttggtgattaatgaacaacgttaatggtggaagtggtggcagtggggatttcgaatgagatttttctttttaacgattagcactagacaacacgactatgagaaatacccaagggtcatctggctagctctacaaggtggtaggccagatgatctgggttcaaagcctcgccccttttaattatttgatattagtctttttctaatattcatgtcttttactagacagtacgattattcatcgaatagaatatgaaaaaattacaagattaattagagacctagaagacaatagctaggaaagaagaaaaaaaatccaccaccacgcaccgacgtcatctacacacagccaaggagaaggtttagcaccggaccagtcggcgctaagcgtgaccgactgccgctaaaccaacaagggtatgggaatgaccgctaagattgcccaagtccaagctataacagccgagcatcaaacacaactctagccacatctataaaattgaggggaagaggatgagagagaagaattgaaccgctctctacgctaggccctctaacgtggccaatttgtttaaactagggcgccaccacaagaggatgagacatctaaagtgagcttgcaccagttatctatgataagatttgtcaagggggctttctagatgacgtctccagggacaggagcgacaatgacactgccgccaccatccgtcgaggtcttaaggagaactaagacaagattttcactcgataaccctacaagaggagaggggatggctcgacaacaccccgaagaagtaagatggcgcctgaagcgccagccaagaccgggctgggtttacacccgccgtcccgccacctgccgatcgaaagctgtgctccattgctacaaccaccatccatcctccgtcgcgcgtgggcaccgttgcaccgccggcccccgccggccaacctccatgcggcctcccactctttgcaccggacagttgtcaggccatcaccgtcgccgaccgccggcctttgccgctccgtcacccacgcctgccacaagccgtcggcctacgtcgcccgtgcccgtcgcaagccgctggcctctgtcgctgtctcctccggtctctagattcggcagcggctgtgccggatctaggcgcgggggagcgggggtggatgtggaggtgggggaggaaggggggcagatctggcagcggtggtgccggggacactatctcgag

SEQ ID NO: 533 - DNA, 1500 bp, Oryza sativa
  Os02g44970 location: Chr2:27240720-27242219
ggttgaattccacagggaaagctcatcatttacaattttctggaaaacaagtcttgactcagacagggcccctaaattagcataacaactcacaatcttagagccaagaatcacatcccagcacaatccatgtgtgaaaacatgacaatggatcttctttagagacctaatatctgcacagccttggaacaatggagcaaacttgtcaaaattaagtatcttattagagcatgaatttgcatcggcagtggatgctgatagtctccaacgcagcttcagcactgcaattttatcaaactttgaactagtgtttccagctaaattcccctcaaaagaattggtagcatcatcatggttgttgacgcaagaaaaacaaaaataggtaactaattgactccgaattcatagacatacgatgacagttcagttaaatgagcctacaatataatagtcccaagcacacatgtgtgagtcatgtgcaatgattacatcatgtgtgcttgggactattatattgtagactcatttaactgaactgtccaattgtggttggtgacatggttcaggagtctaacggtgtaccggaaacagatatagtgtatatctggaagtggagtctataaataggtccctaccctccagcctcataatgcattgtgagcggaacaacggaaaaggaatagagggtaggccggatagacccacgtaaacctaacaatatttgcttttcttgcacctccaaggatagactattcaactaaacctgatcaacagcggaacacatacaatcagtgtactttagtacaacagcactaaacttgatagcagatcacattaaattaagcgataatcccagttatggcatacacagcagaggagtgaagccacaatctctccaggacattgccacaggtaatgaatatgaaatactaccgcaatctcgccggtgctaccaaataaaccaccacctaatcagaacaaatagccacatcatcaagcagtcatcatgtaaaaacgagaaaatgggaaaactgaccaccagccgaaatctttttcagaggttcattccgtgaaagaaccggagtaggaggaggaggcctcggggtggccgccggcaagccgacctccggagggacggcgccaggaacagtggaggaggggcgcgcgcgtgggggaggcgcgggtggtgcggccgtgcgagggggcggcgctgccgctggctagtggagacatcggagttcggagcgaggagaggtggcgtggcgagacggtggggaatcgcgtgggcctttgcgcgtcccggagaaacggccgggtcgaaagcccacactaccattcggcttgggactagctatccatcacgcgacagatttttttttttccgaatcacacagattttatttttttttcaaatcacacagattttagattaattgaattaagctcatttgatcacttgattagaagagttatcaacatatattgcatatattttattta

SEQ ID NO: 534 - DNA, 1500 bp, Oryza sativa
  Os01g25530 location: Chr1:14470301-14471800 (reverse complement)
ggttgtagatgccagaaaaatgaatatgagtaactaattggcttcaaattcacaaacatgttttgcttttattgcacctccaaggatagactattcacctgaacccgatcaacagtaggggacatataatcagtgagctgtagtacagcaacacaaaaaatgatagagaatcacattaaaattaagccagaattccagttatgatgtacacaacaaacaagtgaagtccaggggcggatccaacttgggacatgggggttcagttgaacccccaaacttttgggtgaacaaacaaactgttattacctgaattatttaagagaggtttaaggctatcaaattaaggaggaggagaagatctagaagagaagctagtagggttcacgaacgcaagcaaattccagtcccggtggggtgggagagagagagagatgaatcagaaagaggacgcaccaggatcccctcccctccgctgcgatggagatcgccgcccggccctcccctgttcagccgcgactcgtcttggcggcggcgcaacgaggcaaggagcggaggagacaacgagaggtactcgactactctgcccttatctcaatatttttacttaccactctctacgtcctaatagttttacaaggttcacatccaacatttaactttttatcttatttaaaaatttgaaaattttttaaaaacggacggtcaaaagttcgacacggattttcacggctacacttattagggacaaggtagtattttaaaactagctagtgttatttctttatataactggtgacccatgtatcatcaatacttaggaaaaaattaaacgattgtgtcgacaacaaattcctcataccaccagcaaccgctaactgccactctacgcaccgccatcactgctctttctccatgaatcaccatcgttcttctcctttgcctttacatgcgcagccttaacctctagtaaccgacaagtctttttctcctcccctatcgtgatgcgcactattgttatcgttgccattgaggtcggagatgtcgggcttgcagggactttggaaggcaggagctgacccgacgaagaacgaaggcgctatatccgggctctttcttgctagatctatcggttatccaactgtcgtatggataaagaaaatggagagagagaaagagagagagttaatgtgcgaagtgattactgagtcaccggacttggagatggatagaatatggtggtctaaattaaaatgtaaagttagctattgtgtaaatgaaaatggttaaatgataccattatatgaaaacttttaagaatttttaagaatacatagtatggattgtaatttacttcctttgtcaaaaaaacgaatgtagaactggtgtggcacattctagtacaacaaatctgaacatatgtatgtctagattcgttttactaggatgtgtcacatccaatcctaggttagttttttatgggacgaagggagtacttttttt

SEQ ID NO: 535 - DNA, 1500 bp, Oryza sativa
  Os03g30650 location: Chr3:17474886-17476385
ctccgactctcttgtcttctctgcgtgtgcgcgcgtgttctgctctgtgtttgtgtgggagaaaggttccggcgttcagcgaggtttggaggtaggagtggggccctatttatgcactgattcgaatactactctgtattgtatttacggtggctaattgggattttcttggggtatttttataacgtacttctgtattttacggtgcctaataattgggatttgtttgaggtaggggtgaaaacggtacggaaacagacggaaaccatctttattgtttttgtttttattttatttttggaatcggaaaccccagatacgaaaacggaatcgaatattatcgaaaccgaaaacggagcgaaaacaaaccggcgcgaatacggtaacgaaaatttatcggaataaaaaacccctcaaactgataaatccaattgaataaattgtctatgtttaaaagagtaatgttgttgataaatcccaatataggaaaaaaatattcttatgtaattttagattcgcataacaaatatttttttaaaaaaataacagccaacatcattgtattcactatttagtgcttaaaaaaatacatggtatttcagtcacgaaatttttggtaattccggaaagtttccgaccgattccgagttccgatggaaactgcccttatcatttccgattccgtttccgagaaaatatttccgaattcgtttctgtttctgaaaaattccgaccgacagattccgttttcgaaaataggtctggaatccggaaagattccgtaccgttttcacccctagtttgaggtgataagctttgagatttacctcaagggtcccacgagcaggtgtagattctagaaacgggcagcgcccaggggggggggttgaaaagttcgttgaaggctgtcagaacaccatggaattgaggaattgcgtcaaactggaatgaacatgatgaacacccaagtactggcatgattagtccacttattattcaaagccaaaatggcgtaatggcgtacgtgaatggcgttgcaaaatcatccggactgcgactcgcgcgcggaagcctctgcctccgcggcgccccaacgccgcacgaggatgttctttttcttgacgtcgtgcctcatttcgagcgcagcgagttagccctgttttcccgatcaaaaactttttatcatgtcacatcgaatatttggatacatgtatagtctattaaatatcaaatatagacaagaaaaaacctaattacatagattgcatgtagattacgagatgaatattttaatcataattatgccatgatttggcaatgtggtgctactgtaaacatttgctaatgacagattaattaggcttaataaattcgtctcgcagtttacaggcggaatctgtaatttgttttcttattagactacgtttaatacttcaaatgtgtgtctgtatccttcaaaaacattacacccaaagaactaaacacaccctttgtattgtg

SEQ ID NO: 536 - DNA, 1500 bp, Oryza sativa
  Os01g64910 location: Chr1:37684066-37685565
ggcagcatgccttgccttcgatagttcgatctctagttagcggcaggcgcagtgcaggacagtgaactgattgcccaagttcttgcttgctgaggactggatgggagaagaatgtagtactagtacttcggaggaaaagagccaaagaaacgctcgtcatggctgacgaaacagttgaaggaatcaggtgattgatcgtgttcgtgtatgatacacggtgtatctggaattctggatccggctccgactccggctcctgtatctgtatatgtcaaaaactggtgtaaacgagatccctcgacggtttgaaagacagttttggctgacgtgatgcttacgtttttttattatttttccgggatcaaattgtcgcatatgcgccatgtcaatgttacgtgggacgaagtcctaatcaaaccagccacgcaaacgtcacatcagtcaaaatcgcctttcaaaccgtcgagggacttcgtttgcacagattttgacagttcagggaccggttgcatctgatttttggtttctaagaacgaaaatcggatttggtgtaaagttaagggatctgaaatgaacttattcatttctaatagggcacatcgccttcatttcaaatgggcctccatgtgccaggcccatatttcgattcgagtgtggcctccatggaccaattgagaaataagttcactttaggtcactcgtattgttggagagtctaatattcattccaggaccaattaaagtggcccatattgcggacgctgaagcccaaaggagttgctcctatggtgcggttggaatggtggatggctgaagatgcctcggaggtagagtagtattctctcattcccaaaataaactggagtaagagcatctccaatagatgactaaaattaaactcccaaaaatcatgtattggggacagccaaaaacatatttagcctaaaatacacccccttctccaagagaggactaaaatttgggagcgcttctagttgcccaatatttggttcaggttggtcctggttttggaggtggctaaattttgggaccatgcttaggagtctgttggagggctgattttcaccaaattcctaaaatttatgttttagtaacctgtttagcattctcttggagatgccctaactaccatctttaagggagtatctaaaacagtgataagtttttttttaaaaaaaatttagatataactatagtataattgatacgtaattacattgtaactatattgtaacataactatgatattggcatagtttggtggtttagtggtacgtgagcattcgacagatcgtgggttctcaatccttgaccactgcatgcattggttaattgttactccctccgtccataaaaaaaacaacctagtactgacacatcctaatactatgaatctagacatacatctgtccggattcgttgtactagaatgtgtcacatctagttctagaattgttttttaatgggacggagggagta

SEQ ID NO: 537 - DNA, 1500 bp, Oryza sativa
  Os07g26810 location: Chr7:15496040-15497539
gaatgatcatgtcgcgaagatctacggggcgacggcgaggcggtgaacgaggtcgttctgctcggcgctccctatgatgttcgggaggcgagtggacagatcgctcgtcgtgacccctgctcctgcgattagatcccacgccggcgatgctgaggcttggctgatgatagtcatgagatcggagatgggggactcggctgccagtcggcgtgcggacgcttccggagttaactgggaccgaagcagcaatcatggtcttggtctggttcaagatgttgaccacgtgatcagattgactgagcttgttctccttgaggagggtgtcgaggagggtgatcgcagcaacagcattctgttgtggggtgcggaaaaccggtgtcccctcaacatcttgctggccgataagatctcgcgctcggcgccctgcatctaaggctcattgccgtcggtcttcagcctccttagcggcccgctcgcgctcctgttgctcacgccgcagccgttcttgctcctgtgcttgacgctcctcctccagtcggcgtcgttcggcttcacgtcgcgcttcggcttctcgggcttggcgttgctcctccgtctcgttatttactcgatgagaggtaataccctactcctgtttggggatttaaatccaccgggtgtagtatagatctgacgatcatatgtgctcatgcccctagagggcctcctgcccaccttatataggatggggggcaggattacaagatagaaaccttaaccaatatagtatcggtttcctaaatttattttacaatattatcaaatcaggactttaggccgctccataatataaaaggaaacgtaatacccaagtcatgatctgttacatattccacagatataagctatcccctatgactagtcggataaccatgccgtgtgggtatggggtacccataatctccacagtagcccctgagaccttcacagtcgaaaagataatcttttctcgaactagattactccaaagccgagtgcttcaatcatcttcgccatgatctcccgagtacttttaccaaatatgaagactgtggagagctgaaaaataaagtcaggtgcaacgactagatgcatctaataggtgtagcccccgactatgtggttggctgaacaaactaagcatatagtcaaggaataaatgattcaaccaaccgagcggttttgataattgtaatcaaccaagtgacttgatatcaatatatagcatatgcggtgtgaatcccccaaataacatgatccaagtaatataccgactgctttgtaaaaattgatgcgagcaacttaaagttgactacatcattgaaaattcacatagcaaaacagctataaagaagcttgaatgttgcaaataaagtattgggcatacgccatgcgcacactgctttaacatatgtgcttaagttactaaaagacacatggtttcaccacacctggaaatatatggcatatgtggtgtaaaat

SEQ ID NO: 538 - DNA, 1500 bp, Oryza sativa
  Os07g26820 location: Chr7:15515227-15516726 (reverse complement)
agctgatgtagcgggtaggggagttgatgttggcgccgtcggctgaattgtggacgcaacggaggaaaccgcttgaacagatggctgaacatcggtgatcaaagatcgataattcgggaagacacctccttgcaagtaaactgggcctgtagcctgatgctcggctatcgaaccatcggctattgtcttcatcatgtttgacaatgtattgactaaaaccccggactgattgatcagagcatgatgcacagcgtaatcaactcgatcttgaaagttgttgaaaaaatcttgtgctagctcattattctgattaagatttccttcttgcggcccttgagcaccatcaccttgagccccacgcgctcctcgcagattgtcgccttgatcgcttggggagccgtcggtagcacctttagtactcggctgagcgtgtatcggctaatactccgataccactctatatcaggatattaaagcaggtataatatatcaaacaaaagcctaacatatttagatacagcaatatcttgatataaagggcagatttagcatatcaatgagacatatagaataaatatggctaaatcagatacgatcggctgaaactccaatgctattctaatcggcaactagaaggcaggctagagatcgatattctaagcacgacttaatagatcaaactcaacttatgcagcattaagtatgaaaagaagaacgatatctagacaatcaagccgctagcagttccatagaatggtggatatcttatatgatctagatcaacgtcaagatctaacctaatcggctgccttctgcgtacagatattggccgatagtagattagatagcgatattgttagagattatataagatatatgataactcgacgaattacataaacaagattagagtgtcatgaagatggaagcactaatcccgagaacgcaagccgtcataacaagttttacctcttgttgaatattgaaatcgatgcagctcaacccgaaagcaagaacttgtcgaaacaaaactaaagcaaaaagggtggcgatgcgccgagattgtattggacgtgtgtgttaaaaaattacatagggcccggggtctatttatacccgagaattacaagatatgcccataccggacacgaccattatctctaacaaactccaagataccataagtctttgcggcagatttttgcccacacttatctataaggaatttacataaaatatcctaattaatagatacaattgccttcccaggactctatccatgtatggcaatcatcttgaagtacattaacgtgaacccgatgtcgcgatcaagccgtattgtcggaatcggctgtatcggcttatttagctcgactcagacccagccgatcttaaccgtagccgatctggactccagccgattcctgctcagccgattcctactctgtttccgaactcgatctccgcctccgactccgctttgatcaaatcctctttcct

SEQ ID NO: 539 - DNA, 1500 bp, Oryza sativa
  Os09g11220 location: Chr9:6225987-6227486
cgggctagctacccccttatcaagagcctccacctcatcggctcatcccattctcttcctcacctccccctctcttctctttcgtgatccctcttcctcctcctcctctctctctctctctctctcacacacaccaattccacctcaaaacgcatgaatatagatgatgggttcatttgtatggccgtatgaagtttacaatgatccctgtattttctatcttccttatcatccttatccaaagctcttgctcgatgtctccgattgtgttcttcaaaaacacctacttattgtttgattgctttggtcttttgtgaagcaaaataaaaaagagcttgaagtggataaaatttttcccatgccttcccatgaaatcagtagcgaaggaatctttccttctatttttcgtacggctggtgtgttccatctcctccagatcctcggacgtagcactcgctacgtcagagggacatccggcgcagctgcgtcgttcataccgcatcggatgaacgcacgcagtgaggcggccaaacgggctcaaactcggtccaagtcactgaaataggacggctcatttgaacagaaggctcgtttccttagccagaaaaatcggtgtcgctcccaagttctccaggacatcagccggcggccgctcatcgtctcctccggctcaggcgctattggagccgatctcggacaaagcccctcccctcgtcgccgccctcctcaccatccctcgactcctcacgtggcgcgatgtcacgccctgaagttttccccctttttcttgctttaaaaatttgtttaataaattgcctcaagaaataatttgattaacctagagctaattccttaattaataaatgcaatcaataattggaaatggcattgtgggatttttcttgggttccacttgtcacatttcattaacgggatttttagtagaattttcatagccctataaatagttttaaccaataaaaatcaattatccgcaatattctaatcccaggaaaatccttttctttttcctcttttttcttttcctcctttttcctcttcttgggccatcggcccacttggctcctacgctgcccgctcggctgggccggcccacgccccatccctcctctctgggacgccgataggtggggcccacctgtcaagtcgtcccctacctctagccgggcagcaaccgccgctgaaaccgcccacgccaccaccgttcccgctctcctccacgccaccactccacaccagtgccccacgcccacgtcgcccgcccactaacccgcttctcccgctcgtgcgtgcgcccgtgaggggcaggattcaatttgaatccccccctctctctctcccccacctccccacgtcgccagccaaatcgggccctttcccggccgtgtccgcctctcccaaacccctatatagcttccctgcgtcctcctctccatttttcccctttccacctccctctcccgtgacctctatcgcacc

SEQ ID NO: 540 - DNA, 1500 bp, Oryza sativa
  Os04g21800 location: Chr4:12352409-12353908
ggtgacgggtttatgacgacagcgggttgcaggtgcgatgatcgtccttcctctcctctctcctccactttcccccggttgcttggctagtggattgtcgggtcccaaaactaatgattcggtaaccgacatgtttagactgtatcaagccctggatcagtagattgatacaggttcaacaatctggatctttattgtatacattttaataaggctccaaaggagatattgttattaccaaatatatgggtatttacaaacttgtggccaactaatacaacagaagctatagaatgaaccaactctaatgttttgcgtagagttaaaccatcaatctaatctatacttgaaaactaaactaaattagaatgagactaacttatatgattgaactcccagcttcggcaaaaactccgaaatgactctgaaaaaggtggggttgaagcaagggtgagtacaacgtactcagcaagctattatattcaatatgaatgtatgaaatagtagcatttgagtagggctagatttacttgcagaaagcagagaatgcagaagaagtgagcctgtaatgattttaatgcaacagtatttaataaagtttggaattaagtttctaaccaaataccatatgagtcccaatgctcaaatccatgagcacggctattcgaatagattcgttttcactttactgcagtaaatgtatgctttacccatagcccacgacgtgacgataatcatcagctttagtcatggcccagcattaggttattaacaatagtggcacctgtttcatgaactctagtccccatgcgctctgaacgtacgttatcagcagcgtgaggagttctggcgttcctggggtatttagagaggactgattgtatgacaccatatcatcgcaatcagggtttacaaacagttcgtgatatcacaatttatctcaaatatttacctatgcctcggtaaatatcacaatattgccctgctcggcataagttttcctcctgcgcgaggacttaaacaagaaccactatacagaggtaccaccttgttaaataacataataacttggtctgtccccatcctagaactgtggtcgtactcgtttgttcttcataagtacttggcagtcttatgtcggttggaacagtactagccacccggaaaatcaaccatttctaccgtaccgttcaaatctaagtttattatatttgtatgcagtctaactaggcatgactaagcaaagctagcatatatctggtttgctatatgttcatgatatgcattcaaaatcatgaagagctaatgcatagaacagaaataaagaatatagggcatttatgctcaaaggagaggaataataacttgccttgctccaatgcaaataaatccgagataggcaacctgattatctgatccttgaaatatcacaagttgccatctaaatataatagactctactggagaagaggaagaaccaaattcaataaaaatcatgaa

SEQ ID NO: 541 - DNA, 1500 bp, Oryza sativa
  Os10g23840 location: Chr10:12223468-12224967 (reverse complement)
gacctcgccccagtgggcatgccaaaaacctcacacccgacacggcaccactttacttaccaagctcaagaacacccaacgtaacgagcagacgcgcagggcagatcaaatatcaccggtacgaaatctgagacaggatagctcatgcggattatgcgtctaaacagctcaacttgcaacgacaagctgatacgcgagctcagctcatagcgataaccttttttttacggggagtaccgatagctgatgcggcgtcggggactcggggcaacgcaacctgatgcgaacaagcgaccgagaaagagaaacatcacataccaaaattacccctaatatatattaagagattactaatctaccctttaaaatatacggttgagattaattctacttgcagtagaatactgcaagtagaaagcaccggagcgtcaccttaaagccaaataatgccttctgaaatctcatgtacaactagaagtagaaaatttctagtggaaatcttgcatccgtggttctatgaatcttgttatctacagtgatcaatcgatcaatcggataacctgttctttgatgaatcttcttgagtttttatcggatggaatttgctgggattgctttgaattcgtgcacaacgccgtcgatctcgatgaggctgcagccggggaccttgtcgatctcgttcctcctcatggcgtcgagttgctggagcccctcctcgatgagtccggcatgacagcacgccgtgaggacgccgaggagggtcacctcgttcggcgtcacgccggctcgttgcatgctggcgaatagagacagggcatcctcgccgcggccgtgcattgcgagacccaggatcatggatatgtaggtataccggcgagacccagcgaccagcggccgcagcaagcctcgtaccggccagcgttcaacagccttctcgcgcacggccacatcctgctcgcgctccgcaccgccgttgccggccttgcgcgcagccgcctcctgctcacgctccacgccgccgtcctcgcgctccctccccgaccgtgtccgcatccgcgccattggtcgctcctggcgcgcggtcgccgctacccgctcccttgccgtggacaacctcgtcggcggcggctgctccctgatattttttttttttggtgtgattcaggtggagaaagatggagccaggggcaatcttgccatttcgaaaaatttctcacctcttttgacccggatattataaaatattgtcttcggtgtcctatagctaattacataatttttgtagtgtccatcagccgtgtctcgtttttgcggtgtctctcagccaattacacgttttttgagtgtcctatagcaaattttgccttcttcgaacggcgggaagaagtttgctttgtaatctatatagtcaacacatactaagtttgatcgtaatcattgcttacacaggatttggtcacatttatgaaaatgacaatatagccatatttgttaaacaaa

SEQ ID NO: 542 - DNA, 1500 bp, Oryza sativa
  Os08g13850 location: Chr8:8268007-8269506 (reverse complement)
gacctcgccccagcgggcatgccaaaaacctcacacccgacacggcaccactttacttaccaagctcaagagcacccaacgtaacgagcagacgcgcagggcagatcaaatatcaccagtacgaaatcgagatgggatagctcatgcggattatgcgtctaaacagctcaactcgcaacgacaagctgatacgcgagctcagctcatagcgataaccttttttttacggggaataccgatagctgatgcggcgtcgggggctcggggcaacgcaacctgatgcgaacaagcgaccgagaaagagaaacatcgcatatcaaaattacccctaatctgtattaagagattactaatataccctttaaaatatacggttgagattaattctacttgcagtagaatactgcaagtagaaagcactggagcgtcaccctagttgtaaatgggcaccattctttgattctctcgtgatgcatatatacattacgaagaatgtcaaaatataactactggtgtgaacatgaagttatggttgtttggtttcattcatcaaggttcaaatctttatgtccatatacacatctcgcatgtgtattttaattggtgcagagaggcggtcattctatttctcttgttaaaaaaaaaaatcaaactataaccatgtgttcgccatgctttataccttccatacaaaacttgggtcataaatgtgagctgccaaagtgatcttaatggtttagaagtaagttgcttcctaacatggctccattatagaagaagaaaacaatgtttcattcatctcctttaaaccaagatgaaattaagaagccctcttcctagttgcgggccaggaagcgactaaccatttgtggacaagcacagccaagtaaagccccaaatctcatattgttgtaggacaagataaggttgacaacacacccaggttttgtccatgttgatgatcaattagtttggttgttcaactgtcccgattaacatcttcaaagcaaagcttccaacagaccaacagtacattgaatgaaccgaacaaaacagaagagaatagatggtttctttgcatttaagttttattgtaccacttcgactcatttgtattcaagttttacgaaacttcttgattaactgaaaactgggctaggtatacttagcccgaccaatcagatatgacttttcacccttcctttttcaccaattaactaggaaagtatcccgcgcatgcattcgtgtgcggggatgcatatattagtttgtttcaaaaacacatcaaaatctaaattaaaagtaagatgttttcctttattctaattgaatgttcattggcactctttctttccataagcaatctcgatttttaccgctgatgaatgtattttattataatgtcaagctggacatccctctaataggtttaattgcatatagtttacaaaattggaggaaatatcatctcggtgatatttgacaccataaaatatgatg

SEQ ID NO: 543 - DNA, 1500 bp, Oryza sativa
  Os12g42980 location: Chr12:26703270-26704769
ggtttgccagaaggcagcaacgagagagagaggcgatcgaattcagtgagctgtggcgtaattgcccaagccacagctctctctctccctctctctctctgcctataaataagtgtttgcagctacgaaaattcaatcggggaaaaactatatgggattatcctattgatttatttatggtatgcaggatatggaggcttcgcaaattcgtttgttgtcgcctgtgggacatcgatatcagagtagaattgtttaggctcgtactccctatgtcaaaaaaaaaacccacttctataaatgaatctggacatacacggacatagtgtatgtccagattcgttttttttacgaagagagcacaacatatgtctattgtcgatacttttttgagatcagtatataaaataggtggtactagattaacgatgggctagatggttaataatgagcatatatgtgcaatagatgaaacatgtctatacaagtatagtggtatactgctacaggtaatttgttactatgtgtcagttcaattgtacagttttaaatattattactactatatcacaatatgatacttgagtgtttttactatgggagactcccctgctgtgttttggttaagagtgagcccttctcatatgagtgattcttactctcccgtcccaaaaaaaactcaacctaggaggggatgtgagacaacgaatctggataaatggtagtccagattcattgtactaggaggggtcacatcccctcctaagttgagtttttttttatggaggaagtatactactccctccgtttcaggttataagactttctaccattgcctacattcatatatatatatatatatatatatatatatatgggttagaaagtcttataatataaaacgaaggtagtactgtacatatgattgggtatgggtgtttcttataattgtgactttcagataataaaataatatcccatgttttttttaaactaaataatatccgatgtttttattccattatcataaggaaaaaaaatcccatgaatgatatcattgccggcggttgcctgtggcatgcaagcagttggcagattcttctcgtctcacagcatattgtcccttggcccttgggcattccaaatttctaccaataatttcattctaagaactaaagtcgacgtcgccatcccggtgcacgcacgccggccatgctagcttgcagatagaattggaatagttagccaagccaactccaaccaaagaccctacacatcaccatcctatccgttctacacgatgaaatattcactccatttctaatatacgttgtcatcgatttgtagtgcgtgaacagtgattttattaaaaaaatgtaaatataaaagaatatatgtaagtcatacttaaagcagctttaatggtaaaaataaataacaacaaaaaatattattattattacatattttttcagtaaggttaaagataaaacatgtgtacag

SEQ ID NO: 544 - DNA, 1500 bp, Oryza sativa
  Os03g29280 location: Chr3:16670214-16671713 (reverse complement)
cgtggcctgcgaccgcgagtggtcagtgtgtccttctgtgtatagttggaatcttttcgatatacttctgtgtatagttagagtttcgaggggcgagttgaaaccttaaaagacgtaaccagtagaaaaaaaaacaaacacaccaccatcataaagtagaaaaaaaaacaaacacaccaccatcataaactagcaggtcctcgcacaacaccctaaagaaaactctaaagtgttgtgcgaggacttactagtttatgatgataaactagtaattcctcgcacaacaccctaaagaaaactctagggtgatgtgcgagggcctgccgttttatgaaggtggtgtgtttgtttttttttcctactggttacgtcttttcaggttatgatattatagttatttcctgttatatccgtacgaacttcgcgctatctaaatataaatcgtaaaaaaatatatactccctccgtttcaaaatatttgacacgctatttattaccatggctagcaatgattttaaaattgtggcaacatgtatttattgctacaattttagtattgatgccacgatttttttcgtggcaacaaatgatttttctagtagtgattgtcaaatgtaataaataaagggttgtgttgatagttatcaagtggtgttttggtggcaaggtgccagggtgcttgaggttagaccggcgtggtaaggcgggtcagattggaagtgtttgtgcggtcagaccggccggatagctgtggtctaaccataggtgtttgagcggtcagactaggtagcccgacagtgggaacgatatactcctgtttggagtcggtatcttgttgattttatggaacatgttgattgcttaatgtttattacttctagtttgtttctatacgtgagatatattgtacgttgtgtaccattgttgagtcaagttgataaaaaaacttgtgcttggatatagtttcttagtttgttcatgtgtagttgttacttgaggcctcgggagtattgccggtgatgaatcgagactaagcttgggaaaagttgaggtctagatggacaagaagatcatgcatgatactaaggctagagaacaatgcacgtagagataaagtttccatatggcatgcaagaagagttttgtgcgtatgagaagtggagtcaaatttagattggagtccaagtttaggaagattagagattgaagatgtacagggatgtgtatatccttgttttgagaagtttcctatgtaattaggattccttgttctagttggattcgtggcatgtttgtcggtataattagatgaggggtcgaggctcaaagtaaggtgaagtgggcaacttttaggagagaaaagttaggtttctttttgagatttcggttctagttcgtgaattgagaaaggaatgctttatattccctttgtaagtataacttgatacaataaagtttatccacttttagatgccctttgtaagttaggtttgtgttttt

SEQ ID NO: 545 - DNA, 1500 bp, Oryza sativa
  Os03g20650 location: Chr3:11684335-11685834
tgcctgagctcccatccaccccacccccaaccccacgcgcgcgatcaccaccacctgcgacacacacaaccccgagacgcaccccccccccccaaccctcacgatcaaacaatcaaacacctgacctacgccgcagcaacaacaacgacaacaaccacaaaccacccacacaaacagagcccacactgaccctcgtccctcggcggcggcgcatggcaagaagaagcagagaggagagtggaggtggggaggaggcaagaatttaggattccacaaaggggggtggtgcgcttgggccaatgggggcagacaggaggcgatgcccctctctccctctctctctctctctctctctctcgcttgggaagaatccaaaaagcgatcgacgaggcgagaagcgaaagacgagtgcgtgcgcctgtgctgtgcgtctccgcgcgcgcgcggtgctggaaaagaaagaaagaaagaggcgctgcctttctagctctgtgaccaaggttcgctttgcctttgcctttggtgggcagagggagagagagagggggggttttattcgcgggggagatggcagctgcagaatctgcacaagagagacgggggccaatgtgacacaagagatcaggttattcaggtactcccgccacatcagtctaaggccccacgtaacagtcgcagcgtcactgctctctccaccgcggtgattttttttatttaccgctcacgaatctttttgagtactggaattcggataacaaacgcactcaaacgacgagtactatgttattcctcccttcctacatcgtataatacaagagattcggataagatgtaatatttttcagtactagaatgtgtcacctctctaaattctttagtagcatgaatatgtatatactatttgtccatatttatagtaataaaaaatatgatatccggttctggattattgtattttgagacagatgaagtagttaaattttaaggttttataagaatttattaaaaaaggtattgtttgatagcactatagtaaaagcgcaggaatttgagacggaataaagagaaaacatgaggtctgtttttgtaggagatatttctttgtattccatatgcattcggagccatttctttgtttcagagaatatgaagctagggatctttttccaactaaatttcaattatccaaaattcctctttttttgctgttctaaaaggaacctttaattttatagtatttttcatcgcaagaaaaagttataagtgcgttgttatatgttttcgagaataccgaatttgatgcacaacgggttgccacagaagattcaggtcctaggtgtgtcttcagttccgaatctaatacgagtggctgcctgtactactgcctccctttcacaatataagtcattttagcatttttcatattcatattgatgttaatgatcaatatgaatataaaaaatatagtattttctatattaatattgatgttaatgaatt

SEQ ID NO: 546 - DNA, 1500 bp, Oryza sativa
  Os06g43920 location: Chr6:26453545-26455044 (reverse complement)
tatgcaatcaaagaagagatgttgaattgactcattagagttacaaaagctacaaagcaagctacccttccatcttcttttaacaagattatcttttgttagaatcacccccttttcaatataccaaaggaaaattttaatttttaaaggaatccttagcttccaaattaaagatttcctatgtattacaccattaagcataagggctttatacatggagttaacataaaacaacccttttttattgctcttgcaaaagaattggtcttgcttatcattcaaattgacactcaccacctttgaaacaatttcaagccaatcttccaagtttttccctacaattgctcttctaaaagaaacattcaaagggacccttcctaacacatcggccactaccaagtttttccctaccattgttttcatctagttgatcaaaaagatcttgctgatcaactgtgtcatcgagcacagggagaagaatgccatcttcatccccaccattcagcatctgagccggcatctcagggctgtcgagatgaaagtcaggaaatgtagaaccgaagcttgaatcagttggtgttgaagaactgatgttcgagtcactaccaagtgagaagttgtcatgcatcatctctgctgggcttgtgtcgtttcctatgttgaatgaccccatctgatcatcgaaatctgacagtgatatggtgctcatgattggtgacatttgaccatgtagttcatctccaaacatcggttcctggccactggaggctgcaaagcttgagagctggttgatattggcgatgttcgcctgcgacgggcggaaagatgtcccatcattgtgaccaagatcaggaaacatcgatggtgctgtaggttgccagtatttgctacagtttgcaaggtccggaaattggtaatcattgccaattgtgctgaagtggtttgtagaagattgattcatctgaaccaaaggctgattattcacttcagggtactgcactggaaactgatttgttggcgccaaaaactcaccatttgactgcactggaaactggtttgcaggcaccgaaaacccaccatttgactgcacttgatactgatttgcaggcgccgaaaacccacaatttgactgcactggaaactgatttgcaagagctgaaaacccaaactttgactgtacttgaaactgatttgcaggcgccgaaaccccattatttgacttgtttgcagacgagttgccagaatggcaagatggagagccattgcttgtctcccacatactcttacagaacatgccagcatatgagctaccagaatcgtctgtatccaacaccaagccatttgatatgtttgcaaatgagctcccagatgggccagatgggaagcactttcttgcatttgatgagttctgcagtggctgaaacacaggattgttgcccgggcttccaccatggccaactgtccccatggccatgtttctctggctgttcttgagctgaa

What is claimed is:

1. A transgenic plant having greater photosynthetic resource use efficiency than a control plant;
   wherein the transgenic plant comprises an exogenous recombinant polynucleotide comprising a photosynthetic tissue-enhanced promoter which is operably linked to a nucleic acid sequence that encodes a polypeptide comprising the amino acid sequence of SEQ ID NO: 246;
   wherein the promoter regulates expression of the polypeptide in a photosynthetic tissue to a level that is effective in conferring greater photosynthetic resource use efficiency in the transgenic plant relative to the control plant;
   wherein the control plant does not comprise the recombinant polynucleotide; wherein the promoter does not regulate protein expression in a constitutive manner; and wherein expression of the polypeptide under the regulatory control of the promoter confers greater photosynthetic resource use efficiency in the transgenic plant relative to the control plant.

2. The transgenic plant of claim 1, wherein the photosynthetic tissue-enhanced promoter is an RBCS4 promoter as set forth in SEQ ID NO: 521.

3. The transgenic plant of claim 1, wherein the transgenic plant has an altered trait, relative to the control plant that confers the greater photosynthetic resource use efficiency, wherein the altered trait is selected from the group consisting of:
   (a) increased photosynthetic capacity, measured as an increase in the rate of light-saturated photosynthesis of at least 10% when compared to the rate of light-saturated photosynthesis of a control leaf at the same leaf-internal $CO_2$ concentration, with measurements made after 40 minutes of acclimation to a light intensity that is saturating for photosynthesis;
   (b) increased photosynthetic rate, measured as an increase in the rate of light-saturated photosynthesis of at least 10%, with measurements made after 40 minutes of acclimation to a light intensity that is saturating for photosynthesis;
   (c) a decrease in the chlorophyll content of the leaf of at least 10%, observed in the absence of a decrease in photosynthetic capacity;
   (d) a decrease in the chlorophyll content of the leaf of at least 5% that protects the transgenic plant against photodamage during abiotic stress;
   (e) a decrease in the percentage of the leaf dry weight that is nitrogen of at least 0.5%, observed in the absence of a decrease in photosynthetic capacity or increase in dry weight;
   (f) increased transpiration efficiency, measured as an increase in the rate of light-saturated photosynthesis relative to water loss via transpiration from the leaf, of at least 10%, with measurements made after 40 minutes of acclimation to a light intensity of 700 µmol PAR $m^{-2}$ $s^{-1}$;
   (g) an increase in the resistance to water vapor diffusion out of the leaf that is exerted by the stomata, measured as a decrease in stomatal conductance to $H_2O$ loss from the leaf of at least 10%, with measurements made after 40 minutes of acclimation to a light intensity of 700 µmol PAR $m^{-2}$ $s^{-1}$;
   (h) a decrease in the resistance to carbon dioxide diffusion into the leaf that is exerted by the stomata, measured as an increase in stomatal conductance of at least 10%, with measurements made after 40 minutes of acclimation to a light intensity of 700 µmol PAR $m^{-2}$ $s^{-1}$;
   (i) a decrease in the relative limitation that non-photochemical quenching exerts on the operation of PSII measured as a decrease in leaf non-photochemical quenching of at least 2% after 40 minutes of acclimation to a light intensity of 700 µmol PAR $m^{-2}$ $s^{-1}$;
   (j) an increase in non-photochemical quenching of at least 2% for leaf measurements made after 40 minutes of acclimation to a light intensity of 700 µmol PAR $m^{-2}$ $s^{-1}$ that protects against photodamage to the transgenic plant during abiotic stress;
   (k) a decrease in the ratio of the carbon isotope $^{12}C$ to $^{13}C$ found in either all the dried above-ground biomass, or specific components of the above-ground biomass, leaves or reproductive structures, of at least 0.5‰ (0.5 per mille), measured as a decrease in the ratio of $^{12}C$ to $^{13}C$ relative to the controls with both ratio being expressed relative to the same standard; and
   (l) an increase in the total dry weight of above-ground plant material of at least 5%.

4. The transgenic plant of claim 1, wherein a plurality of the transgenic plants have greater cumulative canopy photosynthesis than the canopy photosynthesis of the same number of the control plants grown under the same conditions and at the same density.

5. The transgenic plant of claim 1, wherein the transgenic plant produces a greater yield than the control plant.

6. The transgenic plant of claim 1, wherein the transgenic plant is selected from the group consisting of a dicot plant, monocot plant, corn, wheat, rice, *Setaria, Miscanthus*, switchgrass, ryegrass, sugarcane, miscane, barley, sorghum, turfgrass, soybean, cotton, canola, rapeseed, *Crambe, Camelina*, sugar beet, alfalfa, tomato, *Eucalyptus*, poplar, willow, pine, birch and a woody plant.

7. A method for increasing photosynthetic resource use efficiency in a plant, the method comprising:
   (a) providing one or more transgenic plants that comprise an exogenous recombinant polynucleotide comprising a photosynthetic tissue-enhanced promoter operably linked to a nucleic acid sequence that encodes a polypeptide comprising SEQ ID NO: 246;
   wherein the photosynthetic tissue-enhanced promoter regulates expression of the polypeptide in a non-constitutive manner; and
   (b) growing the one or more transgenic plants;
   wherein expression of the polypeptide in the one or more transgenic plants confers increased photosynthetic resource use efficiency relative to a control plant that does not comprise the recombinant polynucleotide.

8. The method of claim 7, wherein the photosynthetic tissue-enhanced promoter is an RBCS4 promoter as set forth in SEQ ID NO: 521.

9. The method of claim 7, wherein an expression cassette comprising the recombinant polynucleotide is introduced into a target plant to produce the transgenic plant.

10. The method of claim 7, wherein the transgenic plant has an altered trait, relative to the control plant, that confers the greater photosynthetic resource use efficiency, wherein the altered trait is selected from the group consisting of:
    (a) increased photosynthetic capacity, measured as an increase in the rate of light-saturated photosynthesis of at least 10% when compared to the rate of light-saturated photosynthesis of a control leaf at the same leaf-internal $CO_2$ concentration, with measurements made after 40 minutes of acclimation to a light intensity that is saturating for photosynthesis;

(b) increased photosynthetic rate, measured as an increase in the rate of light-saturated photosynthesis of at least 10%, with measurements made after 40 minutes of acclimation to a light intensity that is saturating for photosynthesis;
(c) a decrease in the chlorophyll content of the leaf of at least 10%, observed in the absence of a decrease in photosynthetic capacity;
(d) a decrease in the chlorophyll content of the leaf of at least 5% that protects the transgenic plant against photodamage during abiotic stress;
(e) a decrease in the percentage of the leaf dry weight that is nitrogen of at least 0.5%, observed in the absence of a decrease in photosynthetic capacity or increase in dry weight;
(f) increased transpiration efficiency, measured as an increase in the rate of light-saturated photosynthesis relative to water loss via transpiration from the leaf, of at least 10%, with measurements made after 40 minutes of acclimation to a light intensity of 700 µmol PAR $m^{-2}$ $s^{-1}$;
(g) an increase in the resistance to water vapor diffusion out of the leaf that is exerted by the stomata, measured as a decrease in stomatal conductance to $H_2O$ loss from the leaf of at least 10%, with measurements made after 40 minutes of acclimation to a light intensity of 700 µmol PAR $m^{-2}$ $s^{-1}$;
(h) a decrease in the resistance to carbon dioxide diffusion into the leaf that is exerted by the stomata, measured as an increase in stomatal conductance of at least 10%, with measurements made after 40 minutes of acclimation to a light intensity of 700 µmol PAR $m^{-2}$ $s^{-1}$;
(i) a decrease in the relative limitation that non-photochemical quenching exerts on the operation of PSII measured as a decrease in leaf non-photochemical quenching of at least 2% after 40 minutes of acclimation to a light intensity of 700 µmol PAR $m^{-2}$ $s^{-1}$;
(j) an increase in non-photochemical quenching of at least 2% for leaf measurements made after 40 minutes of acclimation to a light intensity of 700 µmol PAR $m^{-2}$ $s^{-1}$ that protects against photodamage to the transgenic plant during abiotic stress;
(k) a decrease in the ratio of the carbon isotope $^{12}C$ to $^{13}C$ found in either all the dried above-ground biomass, or specific components of the above-ground biomass, leaves or reproductive structures, of at least 0.5‰ (0.5 per mille), measured as a decrease in the ratio of $^{12}C$ to $^{13}C$ relative to the controls with both ratio being expressed relative to the same standard;
(l) an increase in the total dry weight of above-ground plant material of at least 5%; and
(m) increased yield.

11. The method of claim 7, wherein the transgenic plant is selected for having the increased photosynthetic resource use efficiency relative to the control plant.

12. The method of claim 7, wherein a plurality of the transgenic plants have greater cumulative canopy photosynthesis than the canopy photosynthesis of the same number of the control plants grown under the same conditions and at the same density.

13. The method of claim 7, wherein the transgenic plant is selected from the group consisting of a dicot plant, monocot plant, corn, wheat, rice, *Setaria*, *Miscanthus*, switchgrass, ryegrass, sugarcane, miscane, barley, sorghum, turfgrass, soybean, cotton, canola, rapeseed, *Crambe*, *Camelina*, sugar beet, alfalfa, tomato, *Eucalyptus*, poplar, willow, pine, birch and a woody plant.

14. The method of claim 7, the method steps further including: crossing the target plant with itself, a second plant from the same line as the target plant, a non-transgenic plant, a wild-type plant, or a transgenic plant from a different line of plants, to produce a transgenic seed, wherein said transgenic seed comprises said exogenous recombinant polynucleotide.

15. A method for producing and selecting a crop plant with greater yield or photosynthetic resource use efficiency than a control plant, the method comprising:
(a) providing one or more transgenic plants that comprise an exogenous recombinant polynucleotide that comprises a photosynthetic tissue-enhanced promoter operably linked to a nucleic acid sequence that encodes a polypeptide which comprises the amino acid sequence of SEQ ID NO: 246, and wherein the photosynthetic tissue-enhanced promoter does not regulate protein expression in a constitutive manner;
(b) growing a plurality of the transgenic plants; and
(c) selecting a transgenic plant from the step (b) that has greater photosynthetic resource use efficiency than the control plant, wherein the control plant does not comprise the recombinant polynucleotide; and wherein expression of the polypeptide in the selected transgenic plant confers the greater yield of the selected transgenic plant relative to the control plant.

16. The method of claim 15, the method steps further including:
(d) crossing the selected transgenic plant with itself, a second plant from the same line as the selected transgenic plant, a non-transgenic plant, a wild-type plant, or a transgenic plant from a different line of plants, to produce a transgenic seed, wherein said transgenic seed comprises said exogenous recombinant polynucleotide.

17. The method of claim 15, wherein a plurality of the selected transgenic plants have greater cumulative canopy photosynthesis than the canopy photosynthesis of the same number of the control plants grown under the same conditions and at the same density.

18. The method of claim 15, wherein the selected transgenic plant has an altered trait, relative to the control plant, that confers the greater photosynthetic resource use efficiency, wherein the altered trait is selected from the group consisting of:
(a) increased photosynthetic capacity, measured as an increase in the rate of light-saturated photosynthesis of at least 10% when compared to the rate of light-saturated photosynthesis of a control leaf at the same leaf-internal $CO_2$ concentration, with measurements made after 40 minutes of acclimation to a light intensity that is saturating for photosynthesis;
(b) increased photosynthetic rate, measured as an increase in the rate of light-saturated photosynthesis of at least 10%, with measurements made after 40 minutes of acclimation to a light intensity that is saturating for photosynthesis;
(c) a decrease in the chlorophyll content of the leaf of at least 10%, observed in the absence of a decrease in photosynthetic capacity;
(d) a decrease in the chlorophyll content of the leaf of at least 5% that protects the transgenic plant against photodamage during abiotic stress;
(e) a decrease in the percentage of the leaf dry weight that is nitrogen of at least 0.5%, observed in the absence of a decrease in photosynthetic capacity or increase in dry weight;

(f) increased transpiration efficiency, measured as an increase in the rate of light-saturated photosynthesis relative to water loss via transpiration from the leaf, of at least 10%, with measurements made after 40 minutes of acclimation to a light intensity of 700 µmol PAR $m^{-2}$ $s^{-1}$;

(g) an increase in the resistance to water vapor diffusion out of the leaf that is exerted by the stomata, measured as a decrease in stomatal conductance to $H_2O$ loss from the leaf of at least 10%, with measurements made after 40 minutes of acclimation to a light intensity of 700 µmol PAR m $m^{-2}$ $s^{-1}$;

(h) a decrease in the resistance to carbon dioxide diffusion into the leaf that is exerted by the stomata, measured as an increase in stomatal conductance of at least 10%, with measurements made after 40 minutes of acclimation to a light intensity of 700 µmol PAR $m^{-2}$ $s^{-1}$;

(i) a decrease in the relative limitation that non-photochemical quenching exerts on the operation of PSII measured as a decrease in leaf non-photochemical quenching of at least 2% after 40 minutes of acclimation to a light intensity of 700 µmol PAR $m^{-2}$ $s^{-1}$;

(j) an increase in non-photochemical quenching of at least 2% for leaf measurements made after 40 minutes of acclimation to a light intensity of 700 µmol PAR $m^{-2}$ $s^{-1}$ that protects against photodamage to the transgenic plant during abiotic stress;

(k) a decrease in the ratio of the carbon isotope $^{12}C$ to $^{13}C$ found in either all the dried above-ground biomass, or specific components of the above-ground biomass, leaves or reproductive structures, of at least 0.5‰ (0.5 per mille), measured as a decrease in the ratio of $^{12}C$ to $^{13}C$ relative to the controls with both ratio being expressed relative to the same standard; and (l) an increase in the total dry weight of above-ground plant material of at least 5%.

* * * * *